United States Patent
Giangrande et al.

(10) Patent No.: US 10,633,410 B2
(45) Date of Patent: Apr. 28, 2020

(54) NUCLEIC ACID APTAMERS TO TREAT HISTONE-INDUCED DISEASE STATES

(71) Applicants: UNIVERSITY OF IOWA RESEARCH FOUNDATION, Iowa City, IA (US); Paloma H. Giangrande, Iowa City, IA (US); Kevin Urak, Iowa City, IA (US)

(72) Inventors: Paloma H. Giangrande, Iowa City, IA (US); Francis Miller, Iowa City, IA (US); Kevin Urak, Iowa City, IA (US)

(73) Assignee: University of Iowa Research Foundation, Iowa City, IA (US)

( * ) Notice: Subject to any disclaimer, the term of this patent is extended or adjusted under 35 U.S.C. 154(b) by 0 days.

(21) Appl. No.: 15/538,106

(22) PCT Filed: Dec. 22, 2015

(86) PCT No.: PCT/US2015/067516
§ 371 (c)(1),
(2) Date: Jun. 20, 2017

(87) PCT Pub. No.: WO2016/106387
PCT Pub. Date: Jun. 30, 2016

(65) Prior Publication Data
US 2018/0134746 A1   May 17, 2018

Related U.S. Application Data

(60) Provisional application No. 62/095,530, filed on Dec. 22, 2014.

(51) Int. Cl.
| | | |
|---|---|---|
| C12N 15/115 | (2010.01) | |
| C07H 21/02 | (2006.01) | |
| A61P 29/02 | (2006.01) | |
| A61K 9/00 | (2006.01) | |

(52) U.S. Cl.
CPC ............. *C07H 21/02* (2013.01); *A61K 9/007* (2013.01); *A61K 9/0019* (2013.01); *A61P 29/02* (2018.01); *C12N 15/115* (2013.01); *C12N 2310/16* (2013.01); *C12N 2310/321* (2013.01)

(58) Field of Classification Search
None
See application file for complete search history.

(56) References Cited

U.S. PATENT DOCUMENTS

| | | | |
|---|---|---|---|
| 4,683,195 A | 7/1987 | Mullis et al. | |
| 4,683,202 A | 7/1987 | Mullis | |
| 4,800,159 A | 1/1989 | Mullis et al. | |
| 4,965,188 A | 10/1990 | Mullis et al. | |
| 8,716,218 B2 | 5/2014 | Esmon et al. | |
| 2009/0117099 A1 | 5/2009 | Esmon et al. | |
| 2014/0056959 A1 | 2/2014 | Giangrande et al. | |
| 2014/0234209 A1 | 8/2014 | Chang et al. | |

FOREIGN PATENT DOCUMENTS

WO   2010019446 A1   2/2010

OTHER PUBLICATIONS

Williams et al., Evolution of a histone H4-K16 acetyl-specific DNA aptamer, 2009, JACS, vol. 131, pp. 6330-6331.*
Abrams, et al., "Circulating Histones Are Mediators of Trauma-associated Lung Injury", American Journal of Respiratory and Critical Care Medicine 187, 160-169 (2013).
Allam, et al., "Extracellular histones in tissue injury and inflammation", Journal of Molecular Medicine 92, 465-472 (2014).
Behlke, "Chemical modification of siRNAs for in vivo use", Oligonucleotides 18, 305-319 (2008).
Bosmann, "Extracellular histones are essential effectors of C5aR- and C5L2-mediated tissue damage and inflammation in acute lung injury", The FASEB Journal 27, 5010-5021 (2013).
Chen, et al., "Release and activity of histone in diseases", Cell Death Dis 5, e1370 (2014).
Dassie, et al., "Targeted inhibition of prostate cancer metastases with an RNA aptamer to prostate-specific membrane antigen", Molecular Therapy 22(11), 1910-1922 (2014).
Grailer, et al., "Lung inflammation and damage induced by extracellular histones", Inflammation and Cell Signaling 1(4), doi:10.14800/ics.131, 5 pages (2014).
Hernandez, et al., "Methods for Evaluating Cell-Specific, Cell-Internalizing RNA Aptamers", Pharmaceuticals 6, 295-319 (2013).
Huang, et al., "RNA Aptamer-Based Functional Ligands of the Neurotrophin Receptor, TrkB", Mol Pharmacol 82, 623-635 (2012).
Hyun, et al., "An RNA aptamer that selectively recognizes symmetric dimethylation of arginine 8 in the histone H3 N-terminal peptide", Nucleic Acid Therapeutics 12(17), 2659-2666 (2011).

(Continued)

*Primary Examiner* — Dana H Shin
(74) *Attorney, Agent, or Firm* — Viksnins Harris Padys Malen LLP

(57) ABSTRACT

The present invention relates to methods of using optimized aptamers. In certain embodiments, the present invention provides a method for treating a subject having or being disposed to having a histone-induced injury or disease comprising administering to the subject a pharmaceutical composition comprising a pharmaceutically acceptable carrier and (i) a nucleic acid molecule not more than 90 nucleotides in length comprising an aptamer KU1, KU2, KU3, KU4, KU5, KU6, KU&, KU8, or KU9, wherein the aptamer specifically targets extracellular histones, wherein the nucleotides are RNA; or (ii) a conjugate comprising a nucleic acid molecule not more than 90 nucleotides in length comprising an aptamer KU1, KU2, KU3, KU4, KU5, KU6, KU&, KU8, or KU9, wherein the aptamer specifically targets extracellular histones, wherein the nucleotides are RNA, wherein the nucleic acid molecule is linked to a therapeutic molecule.

17 Claims, 25 Drawing Sheets
Specification includes a Sequence Listing.

(56) References Cited

OTHER PUBLICATIONS

Judge, et al., "Design of noninflammatory synthetic siRNA mediating potent gene silencing in vivo", Mol Ther 13, 494-505 (2006).
Kaul, et al., "Performance of the BioPlex™ 2200 Autoimmune Vasculitis kit", Autoimmun Rev 8, 224-227 (2009).
Keefe, et al., "Aptamers as therapeutics", Nat Rev Drug Discov 9, 537-550 (2010).
Patent Cooperation Treaty, International Searching Authority, Search Report and Written Opinion for PCT/US2015/67516, 13 pages, dated Jul. 12, 2016.
Semeraro, et al., "Extracellular histones promote thrombin generation through platelet-dependent mechanisms: involvement of platelet TLR2 and TLR4", Blood 118, 1952-1961 (2011).
Thiel, et al., "Delivery of chemo-sensitizing siRNAs to HER2+- breast cancer cells using RNA aptamers", Nucl Acids Res. vol. 40 (13), 6319-6337 (2012).
Thiel, et al., "Nucleotide bias observed with a short SELEX RNA aptamer library", Nucleic Acid Ther 21, 253-263 (2011).
Thiel, et al., "Rapid Identification of Cell-Specific, Internalizing RNA Aptamers with Bioinformatics Analyses of a Cell-Based Aptamer Selction", PLOS One, 7(9), e43836 (2012).
Thomas, et al., "Extracellular DNA traps are associated with the pathogenesis of TRALI in humans and mice", Blood 119, 6335-6343 (2012).
Tuerk, et al., "Systematic evolution of ligands by exponential enrichment: RNA ligands to bacteriophage T4 DNA polymerase", Science 249, 505-510 (1990).
Wong, et al., "A double-filter method for nitrocellulose-filter binding: application to protein-nucleic acid interactions", Proc Natl Acad Sci 90, 5428-5432 (1993).
Xu, et al., "Altmetric: 7Citations: 530More detail Letter Extracellular histones are major mediators of death in sepsis", Nature Medicine 15, 1318-1321 (2009).
Yu, et al., "Aptamers can discriminate alkaline proteins with high specificity", Chembiochem 12(17), 2659-2666 (2011).
Urak, et al., "Neutralization of extracellular histones with nucleic acid aptamers for the treatment of critical illness", Oligonucleotide Therapeutics Society, Annual Meeting, Montreal, Canada, 2 pages, Sep. 25-28, 2016.
Urak, et al., "RNA inhibitors of nuclear proteins implicated in multiple organ dysfunction syndrome", American Society of Gene and Cell Therapy, Chicago, Illinois, 2 pages (2018).
Urak, et al., "Treatment of sepsis by neutralization of extracellular histones with nucleic acid aptamers", Molecular Therapy 25(5), Cambridge, MA 02139 USA: Cell Press, 1 page (2017).

* cited by examiner

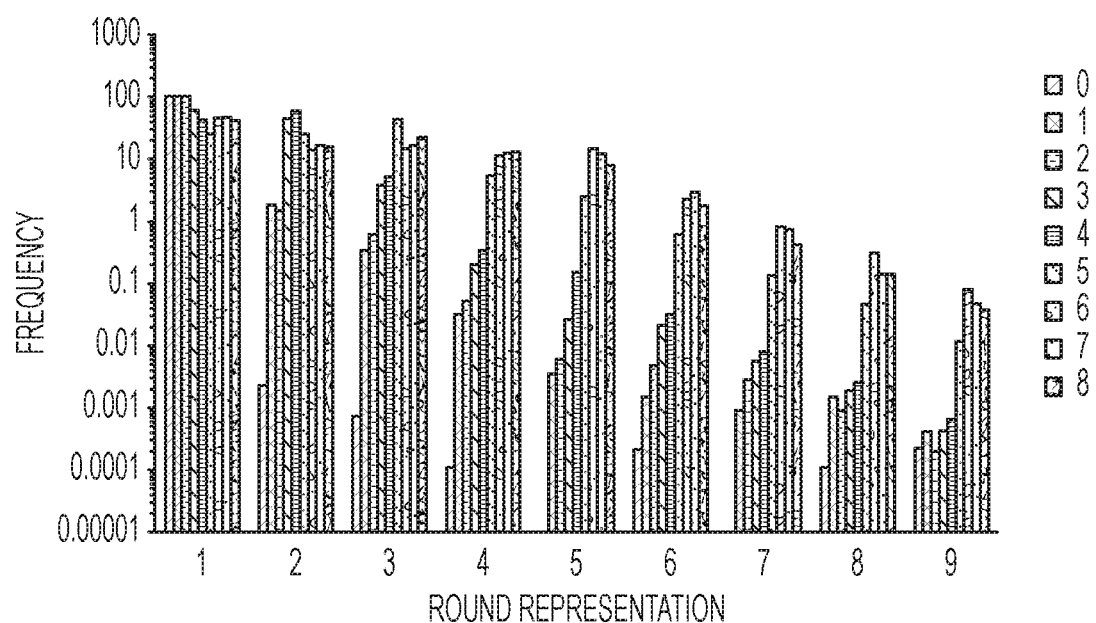
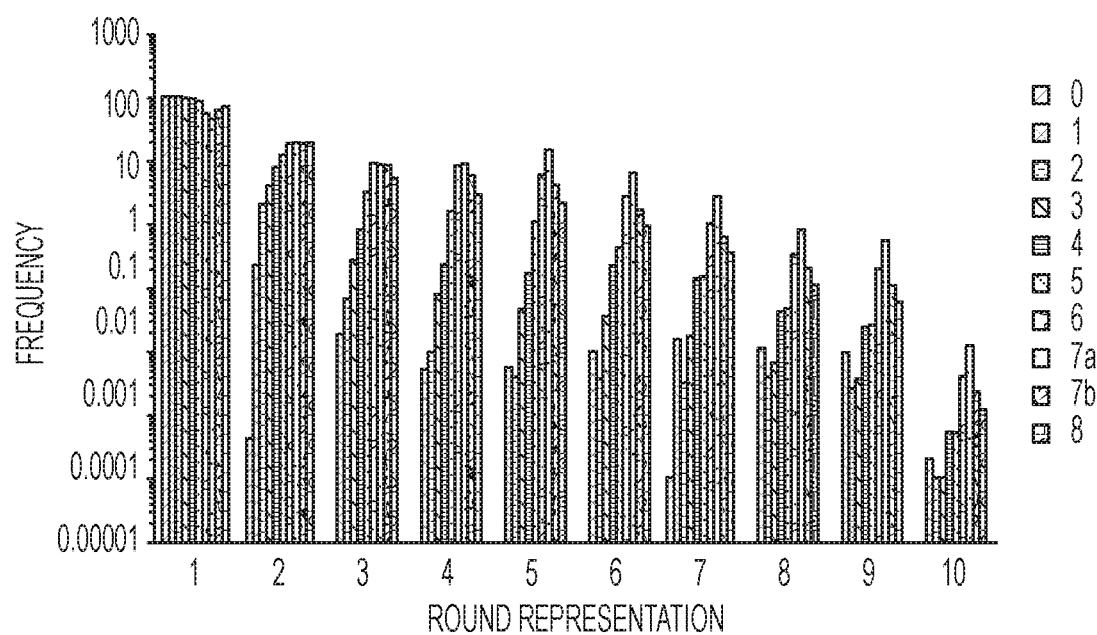
FIG. 9B

| ORIGINAL NAME | SEQUENCE | NAME |
|---|---|---|
| 0002_h3.2/0004_H4 | GGGAGGACGAUGCGGUUGGGUGUAGGGUGUACCGCAGACGACUCGCCCGA | KU1 |
| 0023_H32/0008_H4 | GGGAGGACGAUGCGGUUGAAGGUGAUGGUCCCAGACGACUCGCCCGA | KU2 |
| 0024_H32/0021_H4 | GGGAGGACGAUGCGGUUGAAGGUGAUGGUCCGCAGACGAUCGCCCGA | KU3 |
| 0081_H4 | GGGAGGACGAUGCGGAUCUUUUCUUUCUGCCGCAGACGACUCGCCCGA | KU4 |
| 0065_H4 | GGGAGGACGAUGCGGUUUAUUUCUUUCCACGUUCCGCAGACGACUCGCCCGA | KU5 |
| 0120_H4 | GGGAGGACGAUGCGGUUGUAAUUCUUGUUCCGCAGACGACUCGCCCGA | KU6 |
| 0145_H32 | GGGAGGACGAUGCGGAUGGAGGAGGUCCGCAGACGACUCGCCCGA | KU7 |
| 0236_H32 | GGGAGGACGAUGCGGAUGGAGGAGUGGGAGGUCCGCAGACGACUCGCCCGA | KU8 |
| 0243_H32 | GGGAGGACGAUGCGGAUUGGUGAAGUGAGGUACUGCAGACGACUCGCCCGA | KU9 |

FIG. 10

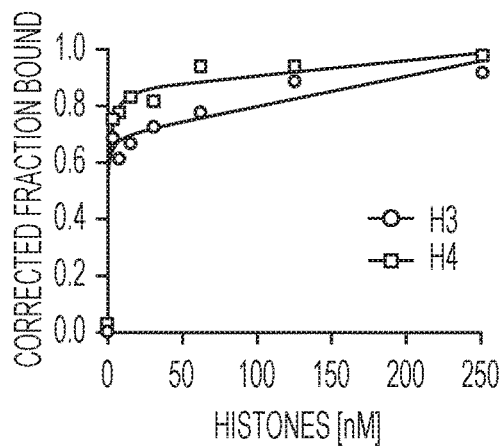
FIG. 16G
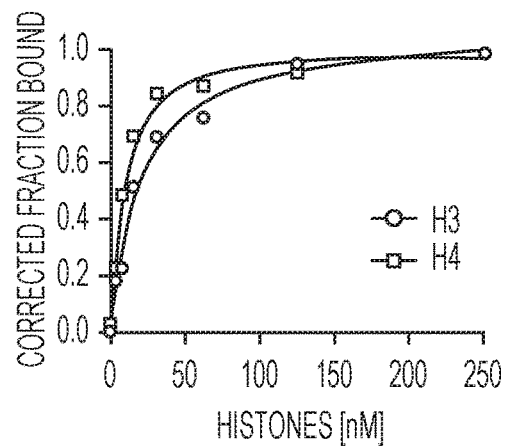
FIG. 16H
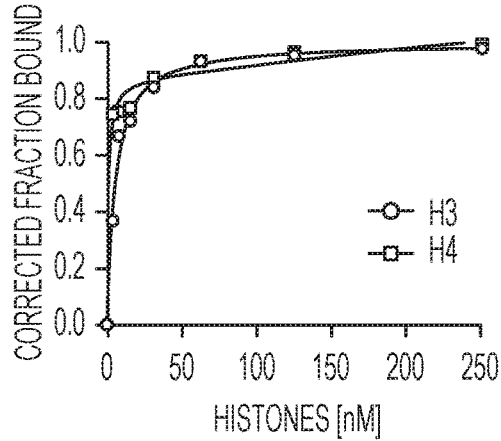
FIG. 16I
| CLONE BINDING AFFINITY TO HISTONE H3 AND H4 | | | | | |
|---|---|---|---|---|---|
| KU1 | $K_D$ (nM) | KU4 | $K_D$ (nM) | KU7 | $K_D$ (nM) |
| H4 | 2.156 | H4 | 18.77 | H4 | 0.41 |
| H3 | 30.18 | H3 | 23.50 | H3 | 2.5 |
| KU2 | $K_D$ (nM) | KU5 | $K_D$ (nM) | KU8 | $K_D$ (nM) |
| H4 | 14.28 | H4 | 0.21 | H4 | 9.463 |
| H3 | 18.40 | H3 | 0.79 | H3 | 19.45 |
| KU3 | $K_D$ (nM) | KU6 | $K_D$ (nM) | KU9 | $K_D$ (nM) |
| H4 | 15.33 | H4 | 0.8234 | H4 | 7.641 |
| H3 | 87.43 | H3 | 1.396 | H3 | 11.17 |
FIG. 17

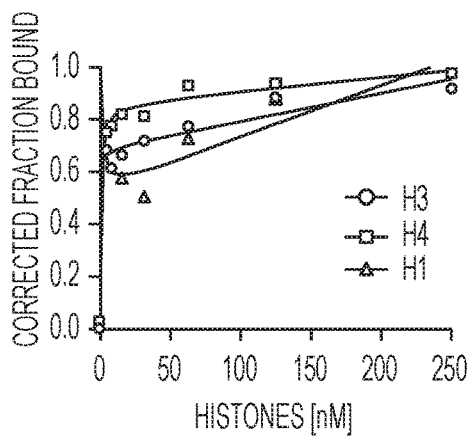
FIG. 18G
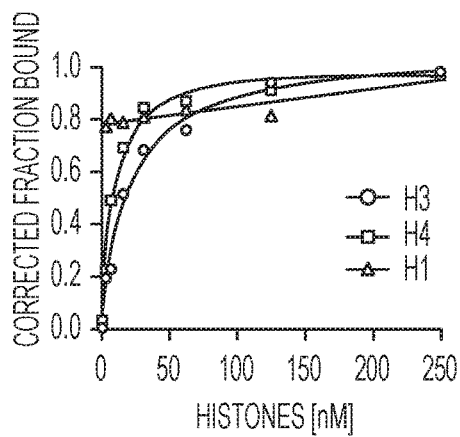
FIG. 18H
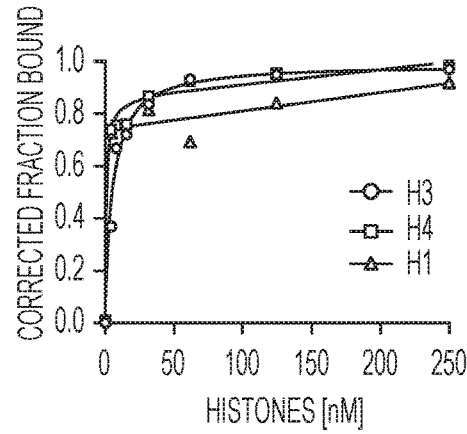
FIG. 18I
| CLONE BINDING AFFINITY TO HISTONE H1, H3, AND H4 | | | | | |
|---|---|---|---|---|---|
| KU1 | K$_D$ (nM) | KU4 | K$_D$ (nM) | KU7 | K$_D$ (nM) |
| H1 | NA | H1 | 2.951 | H1 | NA |
| H4 | 2.156 | H4 | 18.77 | H4 | 0.41 |
| H3 | 30.18 | H3 | 23.50 | H3 | 2.5 |
| KU2 | K$_D$ (nM) | KU5 | K$_D$ (nM) | KU8 | K$_D$ (nM) |
| H1 | NA | H1 | NA | H1 | .035 |
| H4 | 14.28 | H4 | 0.21 | H4 | 9.463 |
| H3 | 18.40 | H3 | 0.79 | H3 | 19.45 |
| KU3 | K$_D$ (nM) | KU6 | K$_D$ (nM) | KU9 | K$_D$ (nM) |
| H1 | 10220 | H1 | .6051 | H1 | NA |
| H4 | 15.33 | H4 | .38 | H4 | 7.641 |
| H3 | 87.43 | H3 | 1.396 | H3 | 11.17 |
FIG. 19

| CLONE BINDING AFFINITY TO HISTONE H3, H4, AND HUMAN SERUM ||||||||
|---|---|---|---|---|---|---|---|
| KU1 | $K_D$ (nM) | | KU4 | $K_D$ (nM) | | KU7 | $K_D$ (nM) |
| HUMAN SERUM | NA | | HUMAN SERUM | NA | | HUMAN SERUM | NA |
| H4 | 2.156 | | H4 | 18.77 | | H4 | 0.41 |
| H3 | 30.18 | | H3 | 23.50 | | H3 | 2.5 |
| KU2 | $K_D$ (nM) | | KU5 | $K_D$ (nM) | | KU8 | $K_D$ (nM) |
| HUMAN SERUM | NA | | HUMAN SERUM | NA | | HUMAN SERUM | NA |
| H4 | 14.28 | | H4 | 0.21 | | H4 | 9.463 |
| H3 | 18.40 | | H3 | 0.79 | | H3 | 19.45 |
| KU3 | $K_D$ (nM) | | KU6 | $K_D$ (nM) | | KU9 | $K_D$ (nM) |
| HUMAN SERUM | NA | | HUMAN SERUM | NA | | HUMAN SERUM | NA |
| H4 | 15.33 | | H4 | .38 | | H4 | 7.641 |
| H3 | 87.43 | | H3 | 1.396 | | H3 | 11.17 |
FIG. 21
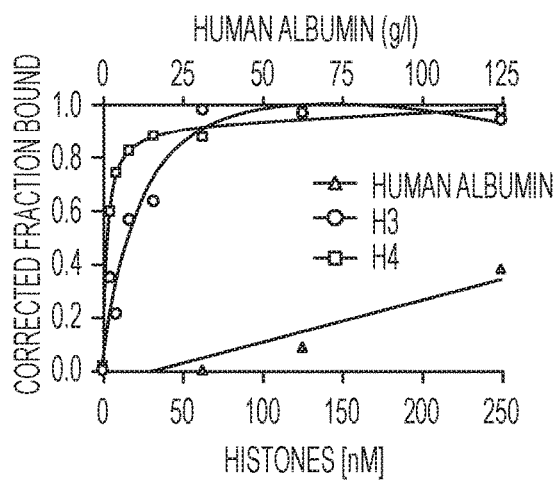
FIG. 22A
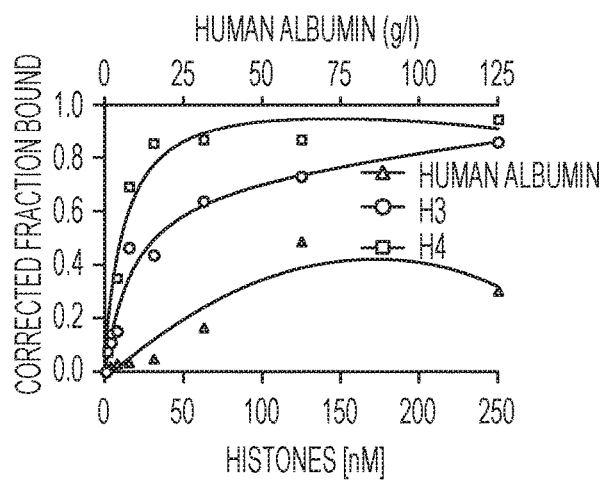
FIG. 22B

| CLONE BINDING AFFINITY TO HISTONE H3, H4, AND HUMAN ALBUMIN | | | | | | | | |
|---|---|---|---|---|---|---|---|---|
| KU1 | $K_D$ (nM) | | KU4 | $K_D$ (nM) | | KU7 | $K_D$ (nM) | |
| HUMAN ALBUMIN | NA | | HUMAN ALBUMIN | NA | | HUMAN ALBUMIN | NA | |
| H4 | 2.156 | | H4 | 18.77 | | H4 | 0.41 | |
| H3 | 30.18 | | H3 | 23.50 | | H3 | 2.5 | |
| KU2 | $K_D$ (nM) | | KU5 | $K_D$ (nM) | | KU8 | $K_D$ (nM) | |
| HUMAN ALBUMIN | NA | | HUMAN ALBUMIN | NA | | HUMAN ALBUMIN | NA | |
| H4 | 14.28 | | H4 | 0.21 | | H4 | 9.463 | |
| H3 | 18.40 | | H3 | 0.79 | | H3 | 19.45 | |
| KU3 | $K_D$ (nM) | | KU6 | $K_D$ (nM) | | KU9 | $K_D$ (nM) | |
| HUMAN ALBUMIN | NA | | HUMAN ALBUMIN | NA | | HUMAN ALBUMIN | NA | |
| H4 | 15.33 | | H4 | .38 | | H4 | 7.641 | |
| H3 | 87.43 | | H3 | 1.396 | | H3 | 11.17 | |

| CLONE BINDING AFFINITY TO HISTONE H1,H2,H2A,H2B,H3, AND H4 | | | | | | | |
|---|---|---|---|---|---|---|---|
| KU5 | K$_D$ (nM) | | KU7 | K$_D$ (nM) | | KU9 | K$_D$ (nM) |
| H4 | 0.2 | | H4 | 0.4 | | H4 | 7.6 |
| H3 | 0.8 | | H3 | 2.5 | | H3 | 11.2 |
| H2B | 2.5 | | H2B | 8.4 | | H2B | NA |
| H2A | 7.5 | | H2A | NA | | H2A | NA |
| H1 | NA | | H1 | 5.0 | | H1 | 5.3 |

NUCLEIC ACID APTAMERS TO TREAT HISTONE-INDUCED DISEASE STATES

RELATED APPLICATIONS

This application is a U.S. national phase application under 35 U.S.C. § 371 of PCT/US2015/067516, filed Dec. 22, 2015, which claims the benefit of priority of U.S. Provisional Application Ser. No. 62/095,530 filed on Dec. 22, 2014, which application is herein incorporated by reference.

SEQUENCE LASTING

The instant application contains a Sequence Listing which has been submitted electronically in ASCII format and is hereby incorporated by reference in its entirety. Said ASCII copy, created on Feb. 2, 2016, is named 17023.163WO1_SL.txt and is 3,639,382 bytes in size.

BACKGROUND OF THE INVENTION

A challenging medical problem often observed in critically ill patients is that in response to severe injury or illness, even those organs not directly affected by the original problem become dysfunctional. For example, patients with severe infection will often develop respiratory failure requiring mechanical ventilation, renal failure requiring dialysis, hepatic dysfunction, coagulation abnormalities, and hypotension requiring vasopressors. This condition, known as the multiple organ dysfunction syndrome (MODS), or by, some of its more prominent manifestations such as acute respiratory distress syndrome (ARDS), can be reversible, but the only treatment is supportive care as there is no therapy to directly prevent or reverse MODS. The incidence of MODS in intensive care unit (ICU) patients is 10-40% and the incidence of death in MODS is 40-50%. Even with survival, organ recovery can take months with significant associated morbidity and cost.

The annual incidence of acute lung injury (ALI) and acute respiratory distress syndrome (ARDS) approximates 200,000 cases in the United States, with mortality approaching 40%. Despite extensive research into the pathogenesis of ALI and clinical trials testing new therapeutics, the improvement in outcomes following ARDS over the past decade are due to improved strategies of mechanical ventilation and advanced support of other failing organs, as there remains no effective pharmacotherapy to treat patients with this syndrome. Furthermore, patients who survive frequently have significant psychological and physical morbidity, residual physical limitations and poor quality of life. The development of ALI/ARDS occurs as a consequence of critical illness of diverse etiologies; however, many of these are highly relevant to the military. For example, despite surviving an initial major trauma (e.g., blast and/or explosive), there is a high mortality associated with the subsequent development of multiple organ dysfunction syndrome (MODS). Postmortem findings show the lungs to be more frequently affected than any other organ in patients who die after trauma. In addition to trauma, other combat and military related causes of ALI/ARDS include toxic inhalation, burns, near-drowning, radiation, sepsis, and blood transfusion. The underlying pathological changes include neutrophil infiltration, pulmonary edema, hemorrhage, and microvascular thrombosis. There are no current methods to prevent the onset of MODS, only treatment of its effects. Thus, there is an on-going need for effective treatments to prevent the development of these syndromes.

SUMMARY OF THE INVENTION

The present invention is transformative because it develops an innovative treatment with preventing the development of MODS/ARDS in high risk patients. Extracellular histones are targeted with RNA aptamers in order to terminate the self-propagating cycle of tissue injury responsible for MODS/ARDS. By interrupting the cycle of histone-mediated cell injury, these histone-specific aptamers save lives and reduce the morbidity and the financial cost of multiple severe illnesses in thousands of patients.

Certain embodiments of the present invention provide a nucleic acid molecule not more than 100 nucleotides in length (e.g., 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nt) comprising an aptamer, wherein the aptamer specifically targets histones. In certain embodiments, the aptamer specifically targets both H3 and/or H4. In certain embodiments, the aptamer specifically targets both human H3 and H4.

In certain embodiments, the nucleotides are RNA. In certain embodiments, the nucleic acid of the present invention is DNA. In certain embodiments, the RNA includes a modified nucleotide.

In certain embodiments, the nucleic acid molecule comprises a chemically modified. RNA comprising a 2' substituted sugar such as 2'-O-methyl-; 2'-O-(2-methoxyethyl); 2-O-alkyl; 2-O-allyl; 2'-S-alkyl; 2'-S-allyl; 2'-fluoro-; 2'-amino; 2'-halo or 2-azido-ribose, a carbocyclic sugar analogue, an a-anomeric sugar; an epimeric sugar such as arabinose, xylose or lyxose, a pyranose sugar, a furanose sugar, sedoheptulose; 2'-fluoro-β-D-arabinonucleotide (FANA) modification; a Locked nucleic acid (LNA).

In certain embodiments, the 2'OMe modified bases are alternated with un-modified RNA bases.

In certain embodiments, the chemically modified RNA comprises a 2'-fluoro pyrimidine and/or a 2' O-methyl pyrimidine.

In certain embodiments, the nucleic acid molecule comprises an 2'OMe purine and a 2'-fluoro pyrimidine.

In certain embodiments, the nucleic acid comprises a bridging, phosphorothioate, and end cap that reverses the polarity of the chain and/or a linker.

Certain embodiments of the present invention provide a conjugate comprising the nucleic acid molecule described above linked to a therapeutic or diagnostic molecule.

Certain embodiments of the present invention provide a pharmaceutical composition comprising a molecule or conjugate as described above and a pharmaceutically acceptable carrier.

Certain embodiments of the present invention provide a method for delivering a therapeutic or diagnostic molecule to a subject having or being disposed to having MODS/ARDS, comprising contacting the subject with the conjugate described above. In certain embodiments, the administration is by intravenous injection or by inhalation. In certain embodiments, the composition is administered within 0-24 hours after an injury. In certain embodiments, the composition is administered within 0-12 hours after an injury. In certain embodiments, the injury is trauma, burn, sepsis, transfusion-related acute lung injury, organ ischemia or diagnosis of illness, or inhalation lung injury. In certain embodiments, the composition is administered in response to a prolonged severe illness. In certain embodiments, the composition is administered multiple times, such as two, three, four, five or six times.

Certain embodiments of the present invention provide a use of a molecule or conjugate as described above for treating MODS/ARDS.

Certain embodiments of the present invention provide a molecule or conjugate as described above for use in therapy.

Certain embodiments of the present invention provide a molecule or conjugate as described above for use in the prophylactic or therapeutic treatment of a histone-induced disease. In certain embodiments, the disease is autoimmune disease (such as systemic lupus erythematosus), arthritis, rheumatoid arthritis, juvenile arthritis; edema; sepsis; septic shock; inflammation; non-septic hyper inflammatory disorder; infectious disease; thrombosis; nephritis; inflammatory liver injury; traumatic hemorrhage; acute pancreatitis; acute respiratory distress syndrome; ischemic injury; ischemic-reperfusion injury; ischemic stroke; cardiovascular disease; atherosclerosis; myocardial infarction; radiotherapy toxicity; cytokine therapy toxicity; granulomatous disease; asthma; graft-vs. host disease, cachexia, a coagulopathy; inhalation injury, trauma, cancer; or burn effects, multiple organ dysfunction syndrome (MODS)/acute respiratory distress syndrome (ARDS), and complications thereof.

In certain embodiments, the method further comprising administering at least one other therapeutic agent to the subject, before, concurrently with or after the composition. The present invention further provides a nucleic acid coding molecule encoding a nucleic acid aptamer molecule as described above.

In certain embodiments, the therapeutic agent is selected from the group consisting of an antibody, an antibody fragment, an immune conjugate, a radionuclide, an immunomodulatory, an anti-angiogenic agent, a pro-apoptotic agent, a cytokine, chemokine a drug, a toxin, a hormone, an siRNA, a cytokine, a chemokine, a coagulation inhibitor, a stem cell growth factor, a lymphotoxin, a hematopoietic factor, a colony stimulating factor, an interferon, erythropoietin, thrombopoietin, an enzyme, recombinant human thrombomodulin and activated human protein C.

As used herein the term "therapeutic effect" refers to a change in the associated abnormalities of the disease state, including pathological and behavioral deficits; a change in the time to progression of the disease state; a reduction, lessening, or alteration of a symptom of the disease; or an improvement in the quality of life of the person afflicted with the disease. Therapeutic effect can be measured quantitatively by a physician or qualitatively by a patient afflicted with the disease state targeted by the aptamer. In certain embodiments wherein both the mutant and wild type allele are substantially silenced, the term therapeutic effect defines a condition in which silencing of the wild type allele's expression does not have a deleterious or harmful effect on normal functions such that the patient would not have a therapeutic effect.

In one embodiment, the RNA aptamers are constructed using known techniques to at least provide as operatively linked components in the direction of transcription, control elements including a transcriptional initiation region, the DNA of interest and a transcriptional termination region. The control elements are selected to be functional in a mammalian cell. The resulting construct which contains the operatively linked components is flanked (5' and 3') with functional sequences, such as sequences encoding an aptamer.

In one embodiment, pharmaceutical compositions will comprise sufficient genetic material to produce a therapeutically effective amount of the aptamer of interest, i.e., an amount sufficient to reduce or ameliorate symptoms of the disease state in question or an amount sufficient to confer the desired benefit. The pharmaceutical compositions will also contain a pharmaceutically acceptable excipient. Such excipients include any pharmaceutical agent that does not itself induce the production of antibodies harmful to the individual receiving the composition, and which may be administered without undue toxicity. Pharmaceutically acceptable excipients include, but are not limited to, sorbitol, Tween80, and liquids such as water, saline, glycerol and ethanol. Pharmaceutically acceptable salts can be included therein, for example, mineral acid salts such as hydrochlorides, hydro bromides, phosphates, sulfates, and the like; and the salts of organic acids such as acetates, propionates, malonates, benzoates, and the like. Additionally, auxiliary substances, such as wetting or emulsifying agents, pH buffering substances, and the like, may be present in such vehicles. A thorough discussion of pharmaceutically acceptable excipients is available REMINGTON'S PHARMACEUTICAL SCIENCES (Mack Pub. Co., N.J. 1991).

BRIEF DESCRIPTION OF DRAWINGS

FIGS. 9A-9B. Bioinformatics analysis of selected rounds.

FIG. 10. Selected aptamer sequences #1 (SEQ ID NOS 7598, 7619, 7620, 10754, 10749, 10765, 7741, 7832, and 7839, respectively, in order of appearance).

FIGS. 16A-16I. Binding of individual RNA aptamers to histones H3 and H4.

FIG. 17. Table of binding affinities.

FIGS. 18A-18I. Binding data of individual RNA aptamers to histones H1, H3 and H4.

FIG. 19. Table of binding affinities.

FIG. 21. Table of binding affinities.

FIGS. 22A-22I. Binding data of individual RNA aptamers to histones H3 and H4, and human albumin.

FIG. 23. Table of binding affinities.

DETAILED DESCRIPTION OF THE INVENTION

Figure 1:
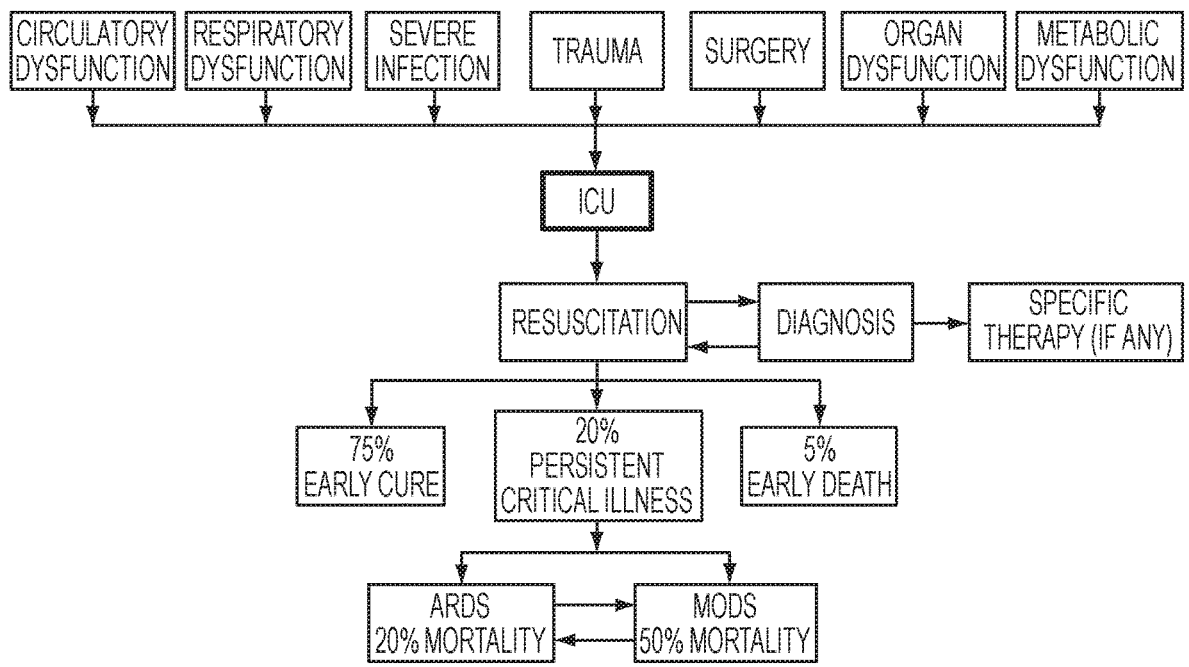
FIG. 1. Pathways of critical illness.

Multiple organ dysfunction syndrome (MODS) is most commonly associated with trauma, sepsis or shock; however a common risk factor appears to be tissue injury (FIG. 1). In addition to trauma and sepsis, the development of MODS/ARDS is associated with a diverse group of clinical scenarios, including pancreatitis, cancer, peritonitis, surgery, acute lung injury, ischemia-reperfusion, radiation, burns, transfusion reactions, and auto-inflammatory disorders. The organs most affected histologically in MODS are in descending order: the lungs, liver, kidney, heart, gut, brain, pancreas and adrenals, though it is likely that most if not all organs are ultimately affected. In addition, disseminated intravascular coagulation is an insidious manifestation of MODS. Endothelial cell death and dysfunction underlies much of the systemic process, resulting in microcirculatory dysfunction and consequent capillary leak, interstitial edema, hemorrhage, and cellular infiltration.

Circulating histones mediate detrimental effects in patients. Recent evidence has suggested that there may be a shared molecular mechanism responsible for the acute lung injury associated with these diverse disorders—and that involves extracellular histones. Eukaryotic genomes are organized in chromatin, a DNA-protein complex whose basic repeating unit is the nucleosome. The nucleosome consists of wrapped around an octamer of histone proteins (two each of histones H2A, H2B, H3, and H4). However, severely injured tissues release large quantities of nucleosomes into the circulation, which are further broken down into individual histones. Elevated levels of circulating histones can be derived either from damaged and apoptotic cells or from the degradation of neutrophil extracellular traps (NETs), which are structures of extracellular histones and DNA that ensnare and kill bacteria. In severely ill patients, an increase in histone levels within 6 hours of admission predicts for mortality. Similarly, in patients with major trauma, circulating histones levels correlate with injury severity, elevated by 4 hours and peaking at about 24 hours after trauma and still detectable at 72 hours. In addition, extracellular histones have been detected in bronco alveolar lavage fluids (BALF) from patients with ARDS but not in BALF from non-ARDS patients. Transfusion-related acute lung injury (TRALI) is the leading cause of death from transfusion therapy in the US. NETs and circulating histone levels are substantially higher in mice and humans with fatal TRALI.

Several lines of evidence have substantiated that circulating histones, not nucleosomes or DNA, mediates these toxic effects. For example, nucleosomes which have been briefly sonicated or exposed to serum (i.e., DNA is degraded and individual histories are released) induce endothelial cell death. Human patient serum with histone levels in excess of 50 µg/ml is toxic to cultured endothelial cells. Intravenous injection of recombinant histones in mice causes endothelial damage, cytokine elevation, platelet aggregation, and microvascular necrosis in the lungs, leading to death.

Extracellular histories mediate tissue damage through multiple mechanisms (FIG. 2) (Chen. R., et al., Release and activity of histone in diseases. Cell Death Dis, 2014, 5: p. e1370). First, histones disrupt cell membranes, resulting in $Ca^{2+}$ influx and subsequent elevations in intracellular $Ca^{2+}$ concentrations and cell damage. In this way, the tissue injury is amplified through release of additional histones into the circulation. Second, histones bind to and activate TLR2 and TLR4, thereby inducing NF-κB and pro-inflammatory cytokine production. Third, histones have been shown to induce a pro-coagulant phenotype in platelets, thereby accelerating blood coagulation and enhancing thrombin generation in a mechanism that involves Toll like receptors (TLR) 2 and 4. Recently, neutrophil extracellular traps were shown to activate platelets leading to thrombosis, and the major contributor to this process was histone H4.8 A fourth mechanism is through increased gut permeability, which allows endotoxin or bacteria to enter the circulation and prime neutrophils. Activated neutrophils then release toxic mediators (i.e., cytokines) to damage lungs and other organs. Consistent with this idea, it has been reported that cytokines, including tumor necrosis factor (TNF)-α, interleukin (IL)-6 and IL-10, are elevated in mice 2 hours after exogenous histone infusion.

Current Attempts to Abrogate Histone-Induced Injury.

Histones represent one of many damage-associated molecular pattern molecules that can initiate and perpetuate immune response; their potential to amplify tissue injury by killing other cells in addition to their agonistic activity on TLRs provides a rationale to target histones for therapy. Unfortunately, approaches currently being pursued in experimental models have marked limitations. First, while TLRs clearly mediate the immune response induced by histones, they have no role in the calcium-mediated cytotoxicity, negating the use of TLR2/4 neutralizing antibodies. Second, several other biologics that demonstrated efficacy in animal models have failed to provide a therapeutic benefit in clinical trials (activated protein C) or have increased risk of bleeding (heparin, APC) or toxicity (histone deacetylase inhibitors). In addition, many biologics require special handling and storage, special dosing considerations, and risk allergic reactions (recombinant proteins and antibodies), which limit their use in situations that are unique to military operations. The development of selective inhibitors of histone-mediated injury is a unique clinical opportunity to interrupt a pathophysiologic cascade responsible for significant morbidity and mortality.

RNA aptamers are single-stranded nucleic acids whose binding properties depend on their sequence and structure.

Aptamers have high binding affinity and specificity with significant advantages over other biologics, including stability at room temperature, resistance to serum degradation, and minimal immunogenicity. Proposed studies will use the in vitro selection technique SELEX (Systemic Evolution of Ligands by Exponential enrichment) to isolate high affinity RNA aptamers against human histories and test efficacy in human pulmonary microvascular endothelial cells and in animal models of histone-mediated ALI.

While aptamers are analogous to antibodies in their range of target recognition and variety of applications, they possess several key advantages over their protein counterparts: (1) they are self-refolding, single-chain, and redox-insensitive, and unlike proteins do not aggregate. They tolerate pH and temperatures that proteins do not. (2) They are easier and more economical to produce. Their production does not depend on bacteria, cell cultures or animals. (5) They can easily be chemically modified to yield improved properties and nuclease resistance for plasma stability (6) Their small size leads to a high number of moles of target bound per gram, and transport properties allowing improved tissue penetration (7) They are much more stable at ambient temperature than antibodies yielding a much higher shelf life, and they can tolerate transportation without any special requirements for cooling, eliminating the need for a continuous cold chain. Another important advantage of aptamers is the feasibility of generating cross-species aptamers that enable testing the same reagent in preclinical animal models and in future human clinical trials. Finally, the clinical potential of aptamers is highlighted by the FDA approval of an aptamer-based drug for macular degeneration and by clinical trials that demonstrate the safety and efficacy of systemically administered RNA.

MODS is described as "the development of potentially reversible physiologic derangement involving two or more organ systems not involved in the disorder that resulted in ICU admission, and arising in the wake of a potentially life-threatening physiologic insult". With the lungs being the organ most commonly involved, acute lung injury (ALI) and acute respiratory distress syndrome (ARDS) may be the primary and most clinically relevant presentation. The annual incidence of ALI/ARDS approximates 200,000 cases in the United States, with mortality approaching 40%. Despite extensive research into the pathogenesis of ALI and clinical trials testing new therapeutics, the improvement in outcomes following ARDS over the past decade are due to improved strategies of mechanical ventilation and advanced support of other failing organs, as there remains no effective pharmacotherapy to treat patients with this syndrome. Furthermore, patients who survive frequently have significant psychological and physical morbidity, residual physical limitations and poor quality of life. The development of ALI/ARDS occurs as a consequence of critical illness of diverse etiologies including initial major trauma, toxic inhalation, burns, near-drowning, radiation, sepsis, and blood transfusion. Furthermore, another common manifestation of MODS is haemostatic abnormalities ranging from subclinical activation of blood coagulation (hypercoagulability) to acute DIC and subsequent consumption of platelets and coagulation proteins causing bleeding.

In response to apoptotic signals, core histones separate from genomic DNA, which results in histone cytoplasmic translocation and subsequent release into the extracellular space. By causing tissue injury (FIG. 2) histones are also involved in a self-sustaining cascade of apoptosis and subsequent histone release. In vivo, histone administration also accelerates cytokine release, endothelial damage, coagulation activation, and lung injury in animal models. Extracellular histones have been implicated in the development of many different disease conditions:

Acute lung injury. Extracellular histones have been detected in Broncho alveolar lavage fluids (BALF) from patients with ARDS but not in BALF from non-ARDS patients.

Transfusion related acute lung injury. Transfusion-related acute lung injury a (TRALI) is the leading cause of death from transfusion therapy in the US. Neutrophil extracellular traps and circulating histone levels are substantially higher in mice and humans with fatal TRALI.

Sepsis. Mice show increased levels of histones in serum after endotoxin administration, H3 and H4 are the major components responsible for this toxicity. Endothelial disruption and consequential coagulation disorders are essential in pathogenesis of sepsis, with 35% of patients with sepsis developing DIC. Changes in the integrity of endothelium are the basis of these severe and mostly fatal complications of sepsis.

Trauma and burns. Histories are released following trauma or severe cellular stress. A cohort study of 52 patients shows that serum histone levels are significantly elevated after severe non-thoracic blunt trauma. Increased serum histones were positively and negatively related to injury severity score and Glasgow Coma Score, respectively High serum histone levels positively correlate with severe complications and poor prognosis.

Ischemia/reperfusion and drug-mediated tissue injury result in sterile inflammation. Serum histone levels are significantly elevated in animal models with liver, kidney, and brain injury, suggesting an important role of histones in the regulation of sterile inflammation. Indeed, circulating histones are major mediators of animal death in several liver injury models including concanavalin A-triggered liver injury, acetaminophen-induced hepatotoxicity, liver I/R, and acute liver failure. Extracellular histories function as damage-associated molecular patterns (DAMPs) and mediate sterile inflammation and organ damage.

Coagulation and thrombosis. Histone administration in mice increases platelet aggregation and subsequent platelet-dependent thrombin formation and microvascular thrombosis. Of them, H4 has the strongest impact on platelet activity. Histones also induce a procoagulant phenotype in human platelets, which enhance thrombin generation and accelerate the blood clotting process. Exogenous histories dose dependently increase plasma thrombin generation in the presence of thrombomodulin.

Autoimmune and auto-inflammatory disorders. Histone release from NETosis has been implicated in a number of autoimmune and auto-inflammatory diseases such as rheumatoid arthritis, systemic lupus, small-vessel vasculitis.

Cerebral infarct. High concentrations of serum nucleosomes are detected in patients with cerebral stroke, especially in patients with large infarction volumes. Serum nucleosome levels rise quickly after post-ischemia, peak at days 3-5, and then fall slowly.

Cancer. Higher concentrations of circulating nucleosomes occur in tumor entities that are highly active or that are detected at advanced stages. An increase in baseline values of circulating histones indicated disease progression, whereas a decrease of the baseline values was an indicator of disease regression.

Ebola and related viral infections. Ebola virus is very pathogenic in humans and induces an acute hemorrhagic fever that leads to death in about 70% of patients. Viral hemorrhagic fever (VHF) is a severe febrile illnesses caused by enveloped RNA viruses from 4 taxonomic families: Arenaviridae, Bunyaviridae, Filoviridae, and Flaviviridae. As the disease progresses, vascular damage with capillary leakage may cause nondependent edema and serous effusions of body cavities such as the pleural and peritoneal spaces. Hemorrhages occur when the patient has thrombocytopenia or severe platelet dysfunction. The extensive multifocal necroses in filoviral infections are probably caused, at least in part, by ischemia associated with fibrin thrombi caused by disseminated intravascular coagulation. The lysis of Ebola-infected cells such as monocytes and macrophages may partially account for cell death. The massive fragmentation of DNA found in the blood and apoptosis vas observed early during disease in all fatalities studied, whereas hemorrhagic signs were observed only in some terminal patients.

Development of RNA aptamers to human histones H3 and H4. The goal of these studies is to identify RNA aptamers that selectively bind with high affinity to both human histones H3/H4. An RNA library of $10^{12}$ RNA sequences (with 2'-fluoro modified pyrimidines) consisting of 51 nucleotide-long, RNA oligonucleotides that include a random region of 20 nucleotides and two constant flanking regions of known sequence (these enable PCR amplification at each selection round). For the first round of selection, the RNA library is pre-cleared against control proteins BSA and human IgG to remove nonspecific binders and removed by capturing the RNA-protein complexes onto a Centrex nitrocellulose centrifugal filter (high protein/low nucleic acid binding filter). Those RNAs that do not bind BSA or human IgG (flow-through after filtering) are collected and incubated with commercially available recombinant human histone H3. The RNA aptamers that bind to histone H3 are captured onto a second Centrex nitrocellulose centrifugal filter, eluted off the filter with chloroform and extracted. The RNA aptamers are then amplified for the next round of selection with RT-PCR using primers specific to the flanking constant regions of the RNA library followed by in vitro transcription via a T7 promoter included in the 5'-PCR primer. For round two of the selection, the pool of RNA derived from round one is pre-incubated with BSA and human IgG for the counter-selection step and the flow-through, containing RNAs that do not bind BSA or human IgG, incubated with commercially available recombinant human histone H4. Those RNAs that bind histone H4 are eluted and amplified as described above. Selection alternates between human historic H3 and H4 for several rounds in order to isolate aptamers that bind to both of these proteins. High affinity aptamers are enriched by modifying the selection conditions (e.g. increasing the RNA:histone ratio during the positive selection step and reducing the incubation time of aptamers with histones H3/H4). The progress of the selection is assessed by determining the sequence diversity of the random regions from round to round by high-throughput sequencing (HTS) and identifying sequence and structure families using bioinformatics analyses. Progress of the selection is assessed by carrying out standard in vitro binding assays (e.g. double-filter nitrocellulose filter binding assays or surface plasmon resonance measurements) with the pools of RNA from each round.

Characterization of individual aptamer sequences. Individual RNA aptamers identified from the sequence analysis are screened for (1) specificity of binding and for (2) ability to inhibit histone activity. In vitro filter binding assays are performed with the top 10-15 sequences from the HTS and bioinformatics analysis. Radiolabeled aptamers re incubated with varying amounts of control proteins (BSA and human IgG) or historic H3 or H4 proteins for 5 min prior to loading onto a dot-blot apparatus. Aptamers bound to histone proteins are retained onto the nitrocellulose filter while unbound aptamers will be retained onto the nylon filter. Membrane filters are quantified using a phospho imager screen and a corrected fraction bound will be determined for each aptamer. Binding specificity is assessed by determining background binding of each aptamer to control proteins (BSA and IgG). A more extensive quantitative determination of binding affinities via surface plasmon resonance is reserved for the 5 aptamers that demonstrate the greatest affinity and specific binding in the filter binding assays. For this work, biotin is coupled to the aptamers during chemical synthesis then immobilized on streptavidin-coupled chips using standard protocols. Recombinant human histone H3 and H4 proteins are injected over the sensor surface for 5 min (association and dissociation time). Various concentrations of histone proteins are injected by serially diluting samples. Concentrations are adjusted based on the binding signal response to obtain optimal affinity determinations. The selectivity studies are carried out by injecting comparable concentrations of several control proteins (i.e. BSA and human IgG) over the immobilized aptamers. The dissociation constant ($K_D$) for each aptamer is calculated by global fitting of four concentrations of histone proteins, assuming a constant density of aptamers on the surface of the chip. A 1:1 binding mode with mass transfer fitting is used to obtain the kinetic data. BSA and human IgG measurements are aligned to histone H3 and H4 data for the non-specific analysis.

Assess functional efficacy of histone specific RNA aptamers. These studies test the ability of the RNA aptamers to neutralize the toxic effects of histories in vitro and in vivo. The best two candidate aptamers that selectively bind H3/H4 in the low pM-low nM range as determined above are used in these studies. Mutated aptamers that do not bind histones serve as negative control aptamers. These studies utilize chemically synthesized aptamers to maximize reproducibility, serum stability, and prevent immune activation. To model circulating histone content, human pulmonary microvascular endothelial cells (EC) or C57Bl/6 mice re exposed to histones purified from calf thymus (contains a heterogenous mixture of core histories) in the presence or absence of aptamer. Human patient serum with historic levels in excess of 50 µg/ml is toxic to EC2; therefore this concentration is used in vitro. Dose response curves for the aptamers are determined in vitro and define the concentration used in in vivo studies.

Endothelial cell culture: Endothelial monolayers are treated with histones (50 µg/ml) with and without one of three aptamers (negative binding, 2 histone binding) at varying aptamer concentrations, based on the $K_D$ for each aptamer determined above (typical range is 1 nm-100 nm). Cells also receive aptamers without histones as a control. The following measurements are made: Measurement of calcium influx. Intracellular calcium concentration is measured using established protocols with fura 2-AM as the fluorescent probe.

Measurement of TLR activation. Expression of IFN-γ, IL-1β, IL-6, and TNF-α by RT-PCR.

Detection of cell toxicity. Live, apoptotic and dead cells are determined by flow cytometry following staining with annexin-V and propidium iodide.

Platelet activation: Blood is collected from human volunteers, platelet-rich plasma prepared, and platelets isolated. Using the histone and aptamer treatment protocol described above, studies are performed in a collagen-coated flow chamber perfused with washed human platelets. The surface area covered by platelet aggregates is quantified. Shear stress conditions are adjusted to replicate the values for arterial (~20 dynes/cm$^2$) or venous shear stress (~3 dynes/cm$^2$). In separate studies, platelet surface marker expression (activated α2bβ3 and P-selectin) are detected by fluorescent antibodies followed by flow cytometry.

Animal model. The best evidence of whether ALI has occurred in an animal is provided by a measurement of the cellular response (such as neutrophil counts in the BALF), a measurement of the integrity of the alveolar capillary barrier (such as movement of high molecular weight proteins from the serum into the airspaces) and histological images showing lung injury. Histones are injected into the tail vein of C57BL/6 mice (50 mg/kg body weight). The two aptamers identified in the in vitro experiments that are most effective and have greatest binding are tested. Animals are pretreated with a control aptamer or one of the two histone aptamers (1 mg/kg or 5 mg/kg, IV) 10 minutes prior to histone administration. These two doses of aptamers represent "low" and "high" doses and are adjusted as indicated on the binding data obtained above. In separate experiments, aptamers are administered at various times after delivery of the histones (5, 15, and 30 minutes) to examine the ability of the aptamer to prevent injury after histone release. Non-invasive determination of respiratory function (reduced O2 saturation) is continuously monitored using a pulse oximeter. After 3 hours (or at the time of death if occurs prior to 3 hours) the mice are killed and the following performed:

TLR activation Blood is collected and serum isolated, and stored at −80° C. Cytokines/chemokines are all quantified using a customized multiplex magnetic bead panel kit.

Alveolar permeability and inflammation: Tracheas are isolated and cannulated and the lungs flushed with sterile PBS. Cytospins of BALF cells are stained with modified Wright-Giemsa. Alveolar permeability is assessed by quantitative detection of mouse albumin in BALF by ELISA.

Lung histology. Lungs are fixed in 4% (w/v) paraformaldehyde for 24 h and embedded and sectioned. Sections are stained with hematoxylin and eosin (H&E) and Mallory's phosphotungstic acid-hematoxylin staining for fibrin then examined by a pathologist for evidence of neutrophils in alveolar spaces, capillary congestion, intra-alveolar hemorrhage, fibrin deposits and thrombi.

Statistical analysis. All data is expressed as mean±SEM. Statistical analysis is carried out using computer software SYSTAT. Results are analyzed using paired and unpaired t-tests for comparisons between two groups. For multiple comparisons, mixed model of ANOVA is employed to compare different treatment groups. Differences between mean values of multiple groups are analyzed with a Newman-Keuls post-hoc test. Differences are considered statistically significant at p values of <0.05.

Animals: The ARRIVE (Animal Research: Reporting In Vivo Experiments) guidelines have been reviewed and are followed for reporting of research findings. Studies are performed in male and female C57BL/6 mice (~10 wks of age), using the minimum number of mice required to address the described protocols. For the animal studies, a power analysis assuming a 25% difference between the control and treatment groups with a standard deviation of 20% for both groups, an alpha error level of 5% (two sided) and a beta error level of 50% indicates a sample size of 8 mice for each study group and for each protocol. Based on these estimates it is estimated that a total of approximately 192 mice (3 aptamers×4 time points×2 doses) are needed to complete the study. Prior to collection of tissues, the mice are euthanized by a barbiturate overdose.

Humans: Healthy individuals (>18 years of age, 50% males) who are not pregnant are recruited from laboratory personnel to donate venous blood for the isolation of platelets. The population recruited reflects the race and ethnic composition of the community. The potential risks of phlebotomy are limited to local pain and local hematoma. Multiple experimental groups are studied from a single 10 ml blood draw.

Aptamer Portion

The present technology uses nucleic acid aptamer constructs that have been created to specifically inhibit the human H3 and H4 histones. In certain embodiments, the constructs are chemically modified (2'-fluoropyridines) RNA constructs making them nuclease resistant. See WO 2010/019446, which is incorporated by reference in its entirety. In certain embodiments the aptamers are RNA. RNA aptamers have the following characteristics: (1) RNA aptamer libraries have a higher structural complexity as compared to DNA aptamer libraries (most DNA aptamers form predictable and similar G-quadruplex structures), thereby increasing the likelihood of identifying aptamers with the desired properties; and (2) RNA chemistries to increase serum stability and safety have been more extensively evaluated for in vivo applications. In certain embodiments, DNA aptamers are used.

Aptamers are single stranded oligonucleotides that can naturally fold into different 3-dimensional structures, which have the capability of binding specifically to biosurfaces, a target compound or a moiety. The term "conformational change" refers to the process by which a nucleic acid, such as an aptamer, adopts a different secondary or tertiary structure. The term "fold" may be substituted for conformational change.

Aptamers have advantages over more traditional affinity molecules such as antibodies in that they are very stable, can be easily synthesized, and can be chemically manipulated with relative ease. Aptamer synthesis is potentially far cheaper and reproducible than antibody-based diagnostic tests. Aptamers are produced by solid phase chemical synthesis, an accurate and reproducible process with consistency among production batches. An aptamer can be produced in large quantities by polymerase chain reaction (PCR) and once the sequence is known, can be assembled from individual naturally occurring nucleotides and/or synthetic nucleotides. Aptamers are stable to long-term storage at room temperature, and, if denatured, aptamers can easily be renatured, a feature not shared by antibodies. Furthermore, aptamers have the potential to measure concentrations of ligand in orders of magnitude lower (parts per trillion or even quadrillion) than those antibody-based diagnostic tests. These characteristics of aptamers make them attractive for diagnostic applications.

Aptamers are typically oligonucleotides that may be single stranded oligodeoxynucleotides, oligoribonucleotides, or modified oligodeoxynucleotide or oligoribonucleotides. The term "modified" encompasses nucleotides with a covalently modified base and/or sugar. For example, modified nucleotides include nucleotides having sugars which are covalently attached to low molecular weight organic groups other than a hydroxyl group at the 3' position and other than a phosphate group at the 5' position. Thus modified, nucleotides may also include 2' substituted sugars such as 2'-O-methyl-; 2-O-alkyl; 2-O-allyl; 2'-S-alkyl; 2'-S-allyl; 2'-fluoro-; 2'-halo or 2-azido-ribose, carbocyclic sugar analogues a-anomeric sugars; epimeric sugars such as arabinose, xyloses or lyxoses, pyranose sugars, furanose sugars, and sedoheptulose.

Modified nucleotides are known in the art and include, by example and not by way of limitation, alkylated purines and/or pyrimidines; acylated purines and/or pyrimidines; or other heterocycles. These classes of pyrimidines and purines are known in the art and include, pseudoisocytosine; N4, N4-ethanocytosine; 8-hydroxy-N6-methyladenine; 4-acetylcytosine, 5-(carboxyhydroxylmethyl) uracil; 5-fluorouracil; 5-bromouracil; 5-carboxymethylaminomethyl-2-thiouracil; 5-carboxymethylaminomethyl uracil; dihydrouracil; inosine; N6-isopentyl-adenine; 1-methyladenine; 1-methylpseudouracil; 1-methylguanine; 2,2-dimethylguanine; 2-methyladenine; 2-methylguanine; 3-methylcytosine; 5-methylcytosine; N6-methyladenine; 7-methylguanine; 5-methylaminomethyl uracil; 5-methoxy amino methyl-2-thiouracil; β-D-mannosylqueosine; 5-methoxycarbonmethyluracil; 5-methoxyuracil; 2-methythio-N6-isopentyladenine; uracil-5-oxyacetic acid methyl ester, psueouracil; 2-thiocytosine; 5-methyl-2 thiouracil, 2-thiouracil; 4-thiouracil; 5-methyluracil; N-uracil-5-oxyacetic acid methylester; uracil 5-oxyacetic acid; queosine; 2-thiocytosine; 5-propyluracil; 5-propylcytosine 5-ethyluracil; 5-ethylcytosine; 5-butyluracil; 5-pentyluracil; 5-pentylcytosine; and 2,6-diaminopurine; methylpsuedouracil; 1-methylguanine; 1-methylcytosine.

In certain embodiments, aptamer modifications include: (a) Nucleotides modified by replacing the 2' position with either a fluoro-(F), amino-($NH_2$) or O-methyl ($OCH_3$) group for enhanced nuclease resistance. These modified nucleotides are introduced either chemically or enzymatically. (b) Bridging phosphorothioates incorporated enzymatically. (c) End caps that involve reversing the polarity of the chain incorporated during chemical synthesis. (d) Linkers inserted at the 5'-ends of aptamers by either chemical or enzymatic means to provide handles for conjugation or to alter pharmacokinetic properties. Keefe et al., *Aptamers as therapeutics*, Nat Rev Drug Discov. 2010 July; 9(7):537-50.

In certain embodiments, modification of the 2'-position of the ribose indirectly improves nuclease resistance of the internucleotide phosphate bond and at the same time increases duplex stability ($T_m$), and also provides protection from immune activation, 2'-O-methyl RNA (2'OMe) is a naturally occurring RNA variant found in mammalian ribosomal RNAs and transfer RNAs. It is nontoxic and can be placed within either the S or AS strands of a siRNA. Heavy modification with 2'OMe RNA can reduce potency or completely inactivate a siRNA; alternating 2'OMe with RNA bases generally retains siRNA function while conferring significant nuclease stabilization. 2'OMe RNA can be combined with other 2'-modifications which are not naturally occurring bases with good results. Behlke, *Chemical Modification of siRNAs for in Vivo Use*, Oligonucleotides 18:305-320 (2008).

The 2'-fluoro (2'-F) modification is compatible with siRNA function and also helps stabilize the duplex against nuclease degradation. Incorporation of 2'-F at pyrimidine positions maintains siRNA activity in vitro and in vivo. The 2'-F modification is even tolerated at the site of Ago2 cleavage. The combined use of 2'-F pyrimidines with 2'OMe purines can results in RNA duplexes with extreme stability in serum and improved in vivo performance. The 2'-O-(2-methoxyethyl) RNA (MOE) modification has been extensively used in antisense oligonucleotides and confers significant nuclease stability to an oligonucleotide as well as increases $T_m$. 2'-MOE residues can be incorporated into siRNAs much like 2'OMe or 2'-F, however this modification is not generally available for use. The 2-fluoro-β-D-arabinonucleotide (FANA) modification has also shown promise in antisense oligonucleotide applications and can also be placed in siRNAs. Substitution of FANA for RNA in the entire S-strand confers significant stabilization to nucleases while maintaining functional potency of the duplex; however, the AS-strand is less tolerant of the FANA modification. Locked nucleic acids (LNAs) contain a methylene bridge which connects the 2'-O with the 4'-C of the ribose. The methylene bridge "locks" the sugar in the 3'-endo conformation, providing both a significant increase in $T_m$ as well as nuclease resistance. Extensive modification of a siRNA with LNA bases generally results in decreased activity (even more so than 2'OMe); however, siRNAs with limited incorporation retain functionality and offer significant nuclease stabilization.

The aptamers of the invention are synthesized using conventional phosphodiester linked nucleotides and synthesized using standard solid or solution phase synthesis techniques which are known in the art. Linkages between nucleotides may use alternative linking molecules. For example, linking groups of the formula P(O)S, (thioate); P(S)S, (dithioate); P(O)NR'2; P(O)R'; P(O)OR6; CO; or CONR'2 wherein R is H (or a salt) or alkyl (1-12C) and R6 is alkyl (1-9C) is joined to adjacent nucleotides through —O— or —S—.

Certain embodiments of the present invention provide a nucleic acid molecule of not more than 90 nucleotides in length comprising an aptamer, wherein the aptamer specifically targets extracellular histones. In certain embodiments of the present invention, the aptamer portion is specific for human histones H3 and/or H4.

In certain embodiments, the aptamer comprises at least 90% identity to an RNA sequence listed in Table 1. In certain embodiments, the aptamer comprises at least 95% identity to an RNA sequence listed in Table 1. In certain embodiments, the aptamer comprises 100% identity to an RNA sequence listed in Table 1.

In certain embodiments, the aptamer specifically targets human H3 and H4. In certain embodiments, the aptamer comprises at least 90% identity to KU1, KU2 or KU3. In certain embodiments, the aptamer comprises at least 95% identity to KU1, KU2 or KU3. In certain embodiments, the aptamer has 100% identity to KU1, KU2 or KU3.

In certain embodiments, the aptamer specifically targets human H3. In certain embodiments, the c aptamer comprises at least 90% identity to KU7, KU8 or KU9. In certain embodiments, the aptamer comprises at least 95% identity to KU7, KU8 or KU9. In certain embodiments, the aptamer has 100% identity to KU7, KU8 or KU9.

In certain embodiments, the aptamer specifically targets human H4. In certain embodiments, the aptamer comprises at least 90% identity to KU4, KU5 or KU6. In certain embodiments, the aptamer comprises at least 95% identity to KU4, KU5 or KU6. In certain embodiments, the aptamer has 100% identity to KU4, KU5 or KU6.

In certain embodiments, additional modifications are made to the aptamer portion. Additional modifications to the aptamer portion include 2'O-methyl modification of the pyrimidines. In other embodiments, all of the nucleotides in the aptamer are 2'O-methyl modified. Alternatively, the pyrimidines, or all the nucleotides, may be modified with 2'fluoros (both pyrimidines and purines). Additional modifications to the nucleotides in the aptamer include large molecular weight conjugates like PEGylation, lipid-based modifications (e.g., cholesterol) or nanoparticles PEI or chitosan) to improve the pharmacokinetic/dynamic profile of the chimera.

Small Molecule Portion

In certain embodiments, the aptamers are linked to other molecules in order to improve clearance (pharmacokinetics and pharmacodynamics). In certain embodiments, the other molecules include PEG, cholesterol or other lipid, nanoparticles. The aptamers of the present invention can be operably linked to one or more small molecule entities. In certain embodiments, the entity is a fluorescent tag, affinity tag, a protein, a solid substrate, a cell surface, or a cellular component. In certain embodiments, the cellular component is a cell wall or cell membrane. In certain embodiments, the solid substrate is a component of silica, cellulose, cellulose acetate, nitrocellulose, nylon, polyester, polyethersulfone, polyolefin, or polyvinylidene fluoride, or combinations thereof. In certain embodiments, the solid substrate is a stent or other medical device, filter, magnetic bead, metal oxide, latex particle, microtiter plates, polystyrene bead, or CD-ROM.

In certain embodiments, the aptamer is linked to the entity by means of a linker. In certain embodiments, the linker is a binding pair. In certain embodiments, the "binding pair" refers to two molecules which interact with each other through any of a variety of molecular forces including, for example, ionic, covalent, hydrophobic, van der Waals, and hydrogen bonding, so that the pair have the property of binding specifically to each other. Specific binding means that the binding pair members exhibit binding to each other under conditions where they do not bind to another molecule. Examples of binding pairs are biotin-avidin, hormone-receptor, receptor-ligand, enzyme-substrate, IgG-protein A, antigen-antibody, and the like. In certain embodiments, a first member of the binding pair comprises avidin or streptavidin and a second member of the binding pair comprises biotin. In certain embodiments, the aptamer is linked to the entity by means of a covalent bond.

The entity, for example, may additionally or alternatively, be a detection means. A number of "molecular beacons" (such as fluorescence compounds) can be attached to aptamers to provide a means for signaling the presence of and quantifying a target chemical or biological agent. Other exemplary detection labels that could be attached to the aptamers include biotin, any fluorescent dye or tracer, amine modification, horseradish peroxidase, alkaline phosphatase, etc.

In certain embodiments, the aptamer is operably linked to a detection means and to a solid substrate. For example, the aptamer may be linked to a fluorescent dye and to a magnetic bead.

In certain embodiments, the small molecules are biologic or pharmacologic agents that can inhibit H3 and/or H4 histones.

Linking Molecules

Chemistries that can be used to link molecules to the aptamer are known in the art, such as disulfide linkages, amino linkages, covalent linkages, etc. Additional linkages and modifications can be found on the world-wide-web at trilinkbiotech.com/products/oligo/oligo_modifications.asp.

Non-Aptamer Therapeutic Agents and Diagnostic Labels

Other non-antibody therapeutic agents targeted against either histones or downstream effectors of a historic mediated pathway may also be utilized in combination with anti-histone antibodies or fragments thereof, administered either before, simultaneously with, or following administration of one or more anti-histone antibodies or fragments thereof. Various therapeutic agents of use in treating histone associated disease states are known in the art, such as activated protein C (APC), thrombomodulin, a peptide fragment of histone H1, H2A, H2B, H3 or H4, granzyme A, granzyme B, plasmin, Factor 7-activating protease, heparin, and any such known agent may be utilized in combination with the subject anti-histone antibodies or antibody fragments. A human histone H4 peptide may comprise residues 50-67 or 40-78 of human H4 (see, e.g., U.S. Publ. No. 20090117099).

In certain embodiments, the therapeutic agent is selected from the group consisting of an antibody, an antibody fragment, an immune conjugate, a radionuclide, an immunomodulatory, an anti-angiogenic agent, a pro-apoptotic agent, a cytokine, a chemokine, a drug, a toxin, a hormone, an siRNA, a cytokine, a chemokine, a coagulation inhibitor, a stem cell growth factor, a lymphotoxin, a hematopoietic factor, a colony stimulating factor, an interferon, erythropoietin, thrombopoietin, an enzyme, recombinant human thrombomodulin and activated human protein C.

In certain embodiments, the antibody, antibody fragment or immune conjugate binds to an antigen selected from the group consisting of histone H2B, histone H3, histone H4, a proinflammatory effector of the innate immune system, a proinflammatory effector cytokine, a proinflammatory effector chemokine, a target specifically associated with infectious disease, acute respiratory distress syndrome, septicemia, septic shock, GVHD, transplant rejection, atherosclerosis, asthma, granulomatous disease, a neuropathy, cachexia, a coagulopathy, acne, giant cell arteritis or myocardial ischemia, TNF-α, MIF, CD74, HLA-DR, IL-1, IL-3, IL-4, IL-5, IL-6, IL-8, IL-12, IL-15, IL-17, IL-18, IL-23, IL-4R, IL-6R, IL-13R, IL-15R, IL-17R, IL-18R, CD40L, CD44, CD46, CD55, CD59, CCL19, CCL21, mCRP, MCP-19, MIP-1A, MIP-1B, RANTES, ENA-78, IP-10, GRO-β, lipopolysaccharide, lymphotoxin, HMGB-1, tissue factor, a complement regulatory protein, a coagulation factor, thrombin, a complement factor, C3, C3a, C3b, C4a, C4b, C5a, C5b Flt-1 and VEGF.

In certain embodiments, the drug is selected from the group consisting of 5-fluorouracil, aplidin, azaribine, anastrozole, anthracyclines, bendamustine, bleomycin, bortezomib, bryostatin-1, busulfan, calicheamycin, camptothecin, carboplatin, 10-hydroxycamptothecin, carmustine, celebrex, chlorambucil, cisplatin (CDDP), Cox-2 inhibitors, irinotecan (CPT-11), SN-38, carboplatin, cladribine, camptothecans, cyclophosphamide, cytarabine, dacarbazine, docetaxel, dactinomycin, daunorubicin, doxorubicin, 2-pyrrolinodoxorubicine (2P-DOX), cyano-morpholino doxorubicin, doxorubicin glucuronide, epirubicin glucuronide, estramustine, epipodophyllotoxin, estrogen receptor binding agents, etoposide (VP16), etoposide glucuronide, etoposide phosphate, floxuridine (FUdR), 3',5'-O-dioleoyl-FudR (FUdR-dO), fludarabine, flutamide, farnesyl-protein transferase inhibitors, gemcitabine, hydroxyurea, idarubicin, ifosfamide, L-asparaginase, lenolidamide, leucovorin, lomustine, mechlorethamine, melphalan, mercaptopurine, 6-mercaptopurine, methotrexate, mitoxantrone, mithramycin, mitomycin, mitotane, navelbine, nitrosourea, plicomycin, procarbazine, paclitaxel, pentostatin, PSI-341, raloxifene, semustine, streptozocin, tamoxifen, taxol, temazolomide (an aqueous form of DTIC), transplatinum, thalidomide, thioguanine, thiotepa, teniposide, topotecan, uracil mustard, vinorelbine, vinblastine, vincristine, a vinca alkaloid, a tyrophostin, canertinib, dasatinib, erlotinib, gefitinib, imatinib, lapatinib, leflunomide, nilotinib, pazopanib, semaxinib, sorafenib, sunitinib, sutent, vatalanib, PCI-32765 (ibrutinib), PCI-45292, GDC-0834, LFM-A13 and RN486.

In certain embodiments, the toxin is selected from the group consisting of ricin, abrin, alpha toxin, saporin, ribonuclease (RNase), e.g., onconase, DNase 1, *Staphylococcal* enterotoxin-A, pokeweed antiviral protein, gelonin, diphtheria toxin, *Pseudomonas* exotoxin, and *Pseudomonas* endotoxin.

In certain embodiments, the immunomodulatory is selected from the group consisting of a cytokine, a stem cell growth factor, a lymphotoxin, a hematopoietic factor, a colony stimulating factor (CSF), an interleukin (IL), erythropoietin, thrombopoietin, tumor necrosis factor (TNF), granulocyte-colony stimulating factor (G-CSF), granulocyte macrophage-colony stimulating factor (GM-CSF), interferon-α, interferon-β, interferon-γ, interferon-λ, TGF-α, TGF-β, interleukin-1 (IL-1), IL-1α, IL-2, IL-3, IL-4, IL-5, IL-6, IL-7, IL-8, IL-9, IL-10, IL-11, IL-12; IL-13, IL-14, IL-15, IL-16, IL-17, IL-18, IL-21, IL-23, IL-25, LIF, FLT-3, angiostatin, thrombospondin, recombinant human thrombomodulin, endostatin and lymphotoxin.

In certain embodiments, the cytokine is selected from the group consisting of human growth hormone, N-methionyl human growth hormone, bovine growth hormone, parathyroid hormone, thyroxine, insulin, proinsulin, relaxin, prorelaxin, follicle stimulating hormone (FSH), thyroid stimulating hormone (TSH), luteinizing hormone (LH), hepatic growth factor, prostaglandin, fibroblast growth factor, prolactin, placental lactogen, OB protein, tumor necrosis factor-α, tumor necrosis factor-β, mullerian-inhibiting substance, mouse gonadotropin-associated peptide, inhibin, activin, vascular endothelial growth factor, integrin, thrombopoietin (TPO), NGF-β, platelet-growth factor, TGF-α, TGF-β, insulin-like growth factor-1, insulin-like growth factor-II, erythropoietin (EPO), osteoinductive factors, interferon-α, interferon-β, interferon-γ, macrophage-CSF (M-CSF), IL-1, IL-1α, IL-2, IL-3, IL-4, IL-5, IL-6, IL-7, IL-8, IL-9, IL-10, IL-11, IL-12, IL-13, IL-14, IL-15, IL-16, IL-17, IL-18, IL-21, IL-25, LIF, FLT-3, angiostatin, thrombospondin, endostatin, tumor necrosis factor and lymphotoxin.

In certain embodiments, the radionuclide is selected from the group consisting of $^{111}$In, $^{111}$At, $^{177}$Lu, $^{211}$Bi, $^{212}$Bi, $^{213}$Bi, $^{211}$At, $^{62}$Cu, $^{67}$Cu, $^{90}$I, $^{125}$I, $^{131}$I, $^{133}$I, $^{32}$P, $^{33}$P, $^{47}$Sc, $^{111}$Ag, $^{67}$Ga, $^{153}$Sm, $^{161}$Tb, $^{152}$Dy, $^{166}$Dy, $^{161}$Ho, $^{166}$Ho, $^{186}$Re, $^{188}$Re, $^{189}$Re, $^{211}$Pb, $^{212}$Pb, $^{223}$Ra, $^{225}$Ac, $^{77}$As, $^{89}$Sr, $^{99}$Mo, $^{105}$Ru, $^{149}$Pm, $^{169}$Er, $^{194}$Ir, $^{58}$Co, $^{80m}$Br, $^{99m}$Tc, $^{103m}$Rh, $^{109}$Pt, $^{119}$Sb, $^{125}$I, $^{189m}$Os, $^{192}$Ir, $^{219}$Rn, $^{215}$Po, $^{221}$Fr, $^{255}$Fm, $^{11}$C, $^{13}$N, $^{15}$O, $^{75}$Br, $^{198}$Au, $^{199}$Au, $^{224}$Ac, $^{77}$Br, $^{113m}$In, $^{95}$Ru, $^{97}$Ru, $^{103}$Ru, $^{105}$Ru, $^{107}$Hg, $^{203}$Hg, $^{121m}$Te, $^{122m}$Te, $^{125m}$Te, $^{165}$Tm, $^{167}$Tm, $^{168}$Tm, $^{197}$Pt, $^{109}$Pd, $^{142}$Pr, $^{143}$Pr, $^{161}$Tb, $^{57}$Co, $^{58}$Co, $^{51}$Cr, $^{59}$Fe, $^{75}$Se, $^{201}$Tl, $^{76}$Br, $^{169}$Yb and $^{227}$Th.

Amplification Methods

In one embodiment of the present invention, the method involves the amplification of selected RNAs. "Amplifying" utilizes methods such as the polymerase chain reaction (PCR), ligation amplification (or ligase chain reaction, LCR), strand displacement amplification, nucleic acid sequence-based amplification, and amplification methods based on the use of Q-beta replicase. These methods are well known and widely practiced in the art. Reagents and hardware for conducting PCR are commercially available. In one embodiment of the present invention, at least one type of aptamer is immobilized on a solid surface.

According to the methods of the present invention, the amplification may be carried out by any means known to the art. Examples of suitable amplification techniques include, but are not limited to, polymerase chain reaction (including, for RNA amplification, reverse-transcriptase polymerase chain reaction), ligase chain reaction, strand displacement amplification, transcription-based amplification, self-sustained sequence replication (or "3SR"), the Qβ replicase system, nucleic acid sequence-based amplification (or "NASBA"), the repair chain reaction (or "RCR"), and boomerang DNA amplification (or "BDA").

The bases incorporated into the amplification product may be natural or modified bases (modified before or after amplification), and the bases may be selected to optimize subsequent electrochemical detection steps.

Polymerase chain reaction (PCR) may be carried out in accordance with known techniques. See, e.g., U.S. Pat. Nos. 4,683,195; 4,683,202; 4,800,159 and 4,965,188. In general, PCR involves, first, treating a nucleic acid sample (e.g., in the presence of a heat stable DNA polymerase) with one oligonucleotide primer for each strand of the specific sequence to be detected under hybridizing conditions so that an extension product of each primer is synthesized that is complementary to each nucleic acid strand, with the primers sufficiently complementary to each strand of the specific sequence to hybridize therewith so that the extension product synthesized from each primer, when it is separated from its complement, can serve as a template for synthesis of the extension product of the other primer, and then treating the sample under denaturing conditions to separate the primer extension products from their templates if the sequence or sequences to be detected are present. These steps are cyclically repeated until the desired degree of amplification is obtained. Detection of the amplified sequence may be carried out by adding to the reaction product an oligonucleotide probe capable of hybridizing to the reaction product (e.g., an oligonucleotide probe of the present invention), the probe carrying a detectable label, and then detecting the label in accordance with known techniques. Where the nucleic acid to be amplified is RNA, amplification may be carried out by initial conversion to DNA by reverse transcriptase in accordance with known techniques.

Strand displacement amplification (SDA) may be carried out in accordance with known techniques. For example, SDA may be carried out with a single amplification primer or a pair of amplification primers, with exponential amplification being achieved with the latter. In general, SDA amplification primers comprise, in the 5' to 3' direction, a flanking sequence (the DNA sequence of which is noncritical), a restriction site for the restriction enzyme employed in the reaction, and an oligonucleotide sequence (e.g., an oligonucleotide probe of the present invention) that hybridizes to the target sequence to be amplified and/or detected. The flanking sequence, which serves to facilitate binding of the restriction enzyme to the recognition site and provides a DNA polymerase priming site after the restriction site has been nicked, is about 15 to 20 nucleotides in length in one embodiment. The restriction site is functional in the SDA reaction. The oligonucleotide probe portion is about 13 to 15 nucleotides in length in one embodiment of the invention.

Ligase chain reaction (LCR) is also carried out in accordance with known techniques. In general, the reaction is carried out with two pairs of oligonucleotide probes: one pair binds to one strand of the sequence to be detected; the other pair binds to the other strand of the sequence to be detected. Each pair together completely overlaps the strand to which it corresponds. The reaction is carried out by, first, denaturing (e.g., separating) the strands of the sequence to be detected, then reacting the strands with the two pairs of oligonucleotide probes in the presence of a heat stable ligase so that each pair of oligonucleotide probes is ligated together, then separating the reaction product, and then cyclically repeating the process until the sequence has been amplified to the desired degree. Detection may then be carried out in like manner as described above with respect to PCR.

Diagnostic techniques that are useful in the methods of the invention include, but are not limited to direct DNA sequencing, pulsed-field gel electrophoresis (PFGE) analysis, allele-specific oligonucleotide (ASO), dot blot analysis and denaturing gradient gel electrophoresis, and are well known to the artisan.

The sample may be contacted with the aptamer in any suitable manner known to those skilled in the art. For example, the sample may be solubilized in solution, and contacted with the aptamer by solubilizing the aptamer in solution with the sample under conditions that permit binding. Suitable conditions are well known to those skilled in the art. Alternatively, the sample may be solubilized in solution with the aptamer immobilized on a solid support, whereby the sample may be contacted with the aptamer by immersing the solid support having the aptamer immobilized thereon in the solution containing the sample.

General Terminology

"Synthetic" aptamers are those prepared by chemical synthesis. The aptamers may also be produced by recombinant nucleic acid methods. "Recombinant nucleic molecule" is a combination of nucleic sequences that are joined together using recombinant nucleic technology and procedures used to join together nucleic sequences known in the art.

A "therapeutic agent" is an atom, molecule, or compound that is useful in the treatment of a disease. Examples of therapeutic agents include antibodies, antibody fragments, peptides, drugs, toxins, enzymes, nucleases, hormones, immune modulators, antisense oligonucleotides, small interfering RNA (siRNA), chelators, boron compounds, photoactive agents, dyes, and radioisotopes. An "antibody" as used herein refers to a full-length (i.e., naturally occurring or formed by normal immunoglobulin gene fragment recombinatorial processes) immunoglobulin molecule (e.g., an IgG antibody). AD "antibody" includes monoclonal, polyclonal, bispecific, multispecific, murine, chimeric, humanized and human antibodies. An "antibody fragment" is a portion of an intact antibody such as $F(ab')_2$, $F(ab)_2$, Fab', Fab, Fv, st, scFv, dAb and the like. Regardless of structure, an antibody fragment binds with the same antigen that is recognized by the full length antibody. For example, antibody fragments include isolated fragments consisting of the variable regions, such as the "Fv" fragments consisting of the variable regions of the heavy and light chains or recombinant single chain polypeptide molecules in which light and heavy variable regions are connected by a peptide linker ("scFv proteins"). "Single chain antibodies", often abbreviated as "scFv" consist of a polypeptide chain that comprises both a $V_H$ and a $V_L$ domain which interact to form an antigen-binding site. The $V_H$ and $V_L$ domains are usually linked by a peptide of 1 to 25 amino acid residues. Antibody fragments also include diabodies, triabodies and single domain antibodies (dAb). Fragments of antibodies that do not bind to the same antigen as the intact antibody, such as the Fe fragment, are not included within the scope of an "antibody fragment" as used herein. In certain embodiments, the antibody is an anti-histone antibody (see, e.g., US 2014/0234209, which is incorporated by reference herein).

A "diagnostic agent" is an atom, molecule, or compound that is useful in diagnosing a disease. Useful diagnostic agents include, but are not limited to, radioisotopes, dyes (such as with the biotin-streptavidin complex), contrast agents, fluorescent compounds or molecules, and enhancing agents (e.g., paramagnetic ions) for magnetic resonance imaging (MRI).

An anti-histone aptamer, antibody or antibody fragment, or a composition described herein, is said to be administered in a "therapeutically effective amount" if the amount administered is physiologically significant. An agent is physiologically significant if its presence results in a detectable change in the physiology of a recipient subject. In particular embodiments, an aptamer, antibody or antibody fragment preparation is physiologically significant if its presence invokes an antitumor response or mitigates the signs and symptoms of an autoimmune disease state. A physiologically significant effect could also be the evocation of a humoral and/or cellular immune response in the recipient subject leading to growth inhibition or death of target cells.

The term "chimeric" refers to a gene or DNA that contains 1) DNA sequences, including regulatory and coding sequences that are not found together in nature or 2) sequences encoding parts of proteins not naturally adjoined, or 3) parts of promoters that are not naturally adjoined. Accordingly, a chimeric gene may include regulatory sequences and coding sequences that are derived from different sources, or include regulatory sequences and coding sequences derived from the same source, but arranged in a manner different from that found in nature.

As used herein, the term "nucleic acid" and "polynucleotide" refers to deoxyribonucleotides or ribonucleotides and polymers thereof in either single- or double-stranded form, composed of monomers (nucleotides) containing a sugar, phosphate and a base that is either a purine car pyrimidine. Unless specifically limited, the term encompasses nucleic acids containing known analogs of natural nucleotides which have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues.

A "nucleic acid fragment" is a portion of a given nucleic acid molecule. Deoxyribonucleic acid (DNA) in the majority of organisms is the genetic material while ribonucleic acid (RNA) is involved in the transfer of information contained within DNA into proteins. The term "nucleotide sequence" refers to a polymer of DNA or RNA which can be single- or double-stranded, optionally containing synthetic, non-natural or altered nucleotide bases capable of incorporation into DNA or RNA polymers.

The terms "nucleic acid," "nucleic acid molecule," "nucleic acid fragment," "nucleic acid sequence or segment," or "polynucleotide" may also be used interchangeably with gene, cDNA, DNA and RNA encoded by a gene, genomic DNA, and even synthetic DNA sequences. The term also includes sequences that include any of the known base analogs of DNA and RNA.

By "fragment" or "portion" is meant a full length or less than full length of the nucleotide sequence.

A "variant" of a molecule is a sequence that is substantially similar to the sequence of the native molecule. For nucleotide sequences, variants include those sequences that, because of the degeneracy of the genetic code, encode the identical amino acid sequence of the native protein. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis that encode the native protein, as well as those that encode a polypeptide having amino acid substitutions. Generally, nucleotide sequence variants of the invention will have in at least one embodiment 40%, 50%, 60%, to 70%, e.g., 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98%, sequence identity to the native (endogenous) nucleotide sequence.

As used herein, "sequence identity" or "identity" in the context of two nucleic acid sequences makes reference to a specified percentage of residues in the two sequences that are the same when aligned by sequence comparison algorithms or by visual inspection.

As used herein, "percentage of sequence identity" means the value determined by comparing two optimally aligned sequences, wherein the portion of the polynucleotide sequence may comprise additions or deletions (i.e., gaps) as compared to the reference sequence (which does not comprise additions or deletions) for optimal alignment of the two sequences. The percentage is calculated by determining the number of positions at which the identical nucleic acid base occurs in both sequences to yield the number of matched positions, dividing the number of matched positions by the total number of positions in the window of comparison, and multiplying the result by 100 to yield the percentage of sequence identity.

The term "substantial identity" of polynucleotide sequences means that a polynucleotide comprises a sequence that has at least 70%, 71%, 72%, 73%, 74%, 75%, 76%, 77%, 78%, or 79%; at least 80%, 81%, 82%, 83%, 84%, 86%, 87%, 88%, or 89%; at least 90%, 91%, 92%, 93%, or 94% or even at least 95%, 96%, 97%, 98%, or 99% sequence identity, compared to a reference sequence using one of the alignment programs described using standard parameters.

Another indication that nucleotide sequences are substantially identical is if two molecules hybridize to each other under stringent conditions (see below). Generally, stringent conditions are selected to be about 5° C. lower than the thermal melting point ($T_m$) for the specific sequence at a defined ionic strength and pH. However, stringent conditions encompass temperatures in the range of about 1° C. to about 20° C., depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code.

As noted above, another indication that two nucleic acid sequences are substantially identical, is that the two molecules hybridize to each other under stringent conditions. The phrase "hybridizing specifically to" refers to the binding, duplexing, or hybridizing of a molecule only to a particular nucleotide sequence under stringent conditions when that sequence is present in a complex mixture (e.g., total cellular) DNA or RNA. "Bind(s) substantially" refers to complementary hybridization between a probe nucleic acid and a target nucleic acid and embraces minor mismatches that can be accommodated by reducing the stringency of the hybridization media to achieve the desired detection of the target nucleic acid sequence.

"Stringent hybridization conditions" and "stringent hybridization wash conditions" in the context of nucleic acid hybridization experiments such as Southern and Northern hybridizations are sequence dependent, and are different under different environmental parameters. Longer sequences hybridize specifically at higher temperatures. The $T_m$ is the temperature (under defined ionic strength and pH) at which 50% of the target sequence hybridizes to a perfectly matched nucleic acid. Specificity is typically the function of post-hybridization washes, the critical factors being the ionic strength and temperature of the final wash solution. For DNA-DNA hybrids, the $T_m$ can be approximated from the equation of Meinkoth and Wahl: $T_m$ 81.5° C.+16.6 (log M)+0.41 (% GC)−0.61 (% form)−500/L. M is the molarity of monovalent cations, % GC is the percentage of guanosine and cytosine nucleotides in the DNA, % form is the percentage of formamide in the hybridization solution, and L is the length of the hybrid in base pairs. $T_m$ is reduced by about 1° C. for each 1% of mismatching, thus, $T_m$, hybridization, and/or wash conditions can be adjusted to hybridize to sequences of the desired identity. For example, if sequences with >90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired T, those of ordinary skill will understand that variations in the stringency of hybridization and/or wash solutions are inherently described. If the desired degree of mismatching results in a T of less than 45° C. (aqueous solution) or 32° C. (formamide solution), it is preferred to increase the SSC concentration so that a higher temperature can be used. Generally, highly stringent hybridization and wash conditions are selected to be about 5° C. lower than the thermal melting point ($T_m$) for the specific sequence at a defined ionic strength and pH.

An example of highly stringent wash conditions is 0.15 M NaCl at 72° C. for about 15 minutes. An example of stringent wash conditions is a 0.2×SSC wash at 65° C. for 15 minutes. Often, a high stringency wash is preceded by a low stringency wash to remove background probe signal. An example medium stringency wash for a duplex of, e.g., more than 100 nucleotides, is 1×SSC at 45° C. for 15 minutes. An example low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.5 M, more preferably about 0.01 to 1.0 M, Na ion concentration (or other salts) at pH 7.0 to 8.3, and the temperature is typically at least about 30° C. and at least about 60° C. for long probes (e.g., >50 nucleotides). Stringent conditions may also be achieved with the addition of destabilizing agents such as formamide. In general, a signal to noise ratio of 2× (or higher) than that observed for an unrelated probe in the particular hybridization assay indicates detection of a specific hybridization.

Very stringent conditions are selected to be equal to the for a particular probe. An example of stringent conditions for hybridization of complementary nucleic acids which have more than 100 complementary residues on a filter in a Southern or Northern blot is 50% formamide, e.g., hybridization in 50% formamide, 1 M NaCl, 1% SDS at 37° C., and a wash in 0.1×SSC at 60 to 65° C. Exemplary low stringency conditions include hybridization with a buffer solution of 30 to 35% formamide. 1M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C.

"Operably-linked" nucleic acids refers to the association of nucleic acid sequences on single nucleic acid fragment so that the function of one is affected by the other, e.g., an arrangement of elements wherein the components so described are configured so as to perform their usual function. For example, a regulatory DNA sequence is said to be "operably linked to" or "associated with" a DNA sequence that codes for an RNA or a polypeptide if the two sequences are situated such that the regulatory DNA sequence affects expression of the coding DNA sequence (i.e., that the coding sequence or functional RNA is under the transcriptional control of the promoter). Coding sequences can be operably-linked to regulatory sequences in sense or antisense orientation. Control elements operably linked to a coding sequence are capable of effecting the expression of the coding sequence. The control elements need not be contiguous with the coding sequence, so long as they function to direct the expression thereof. Thus, for example, intervening untranslated yet transcribed sequences can be present between a promoter and the coding sequence and the promoter can still be considered "operably linked" to the coding sequence.

The terms "isolated and/or purified" refer to in vitro isolation of a nucleic acid, e.g., a DNA or RNA molecule from its natural cellular environment, and from association with other components of the cell or test solution (e.g. RNA pool), such as nucleic acid or polypeptide, so that it can be sequenced, replicated, and/or expressed. For example, "isolated nucleic acid" may be a DNA molecule containing less than 31 sequential nucleotides that is transcribed into an RNAi molecule. Such an isolated RNAi molecule may, for example, form a hairpin structure with a duplex 21 base pairs in length that is complementary or hybridizes to a sequence in a gene of interest, and remains stably hound under stringent conditions (as defined by methods well known in the art, e.g., in Sambrook and Russell, 2001). Thus, the RNA or DNA is "isolated" in that it is free from at least one contaminating nucleic acid with which it is normally associated in the natural source of the RNA or DNA and is preferably substantially free of any other mammalian RNA or DNA. The phrase "free from at least one contaminating source nucleic acid with which it is normally associated" includes the case where the nucleic acid is reintroduced into the source or natural cell but is in a different chromosomal location or is otherwise flanked by nucleic acid sequences not normally found in the source cell, e.g., in a vector or plasmid.

Nucleic acid molecules having base substitutions (i.e., variants) are prepared by a variety of methods known in the art. These methods include, but are not limited to, isolation from a natural source (in the case of naturally occurring sequence variants) or preparation by oligonucleotide-mediated (or site-directed) mutagenesis, PCR mutagenesis, and cassette mutagenesis of an earlier prepared variant or a non-variant version of the nucleic acid molecule.

"Operably-linked" refers to the association of nucleic acid sequences on single nucleic acid fragment so that the function of one of the sequences is affected by another. For example, a regulatory DNA sequence is said to be "operably linked to" or "associated with" a DNA sequence that codes for an RNA or a polypeptide if the two sequences are situated such that the regulatory DNA sequence affects expression of the coding DNA sequence (i.e., that the coding sequence or functional RNA is under the transcriptional control of the promoter). Coding sequences can be operably-linked to regulatory sequences in sense or antisense orientation.

As used herein, the term "derived" or "directed to" with respect to a nucleotide molecule means that the molecule has complementary sequence identity to a particular molecule of interest.

"Treating" as used herein refers to ameliorating at least one symptom of, curing and/or preventing the development of a disease or a condition.

The terms "protein," "peptide" and "polypeptide" are used interchangeably herein.

Dosages, Formulations and Routes of Administration of the Agents of the Invention The agents of the invention are preferably administered so as to result in a reduction in at least one symptom associated with a disease. The amount administered will vary depending on various factors including, but not limited to, the composition chosen, the particular disease, the weight, the physical condition, and the age of the mammal, and whether prevention or treatment is to be achieved. Such factors can be readily determined by the clinician employing, animal models or other test systems, which are well known to the art.

Administration of the aptamer chimera may be accomplished through the administration of the nucleic acid molecule. Pharmaceutical formulations, dosages and routes of administration for nucleic acids are generally known in the art.

The present invention envisions treating a disease, for example, vascular stenosis, restenosis or stroke, in a mammal by the administration of an agent, e.g., a nucleic acid composition, an expression vector, or a viral particle of the invention. Administration of the therapeutic agents in accordance with the present invention may be continuous or intermittent, depending, for example, upon the recipient's physiological condition, whether the purpose of the administration is therapeutic or prophylactic, and other factors known to skilled practitioners. The administration of the agents of the invention may be essentially continuous over a preselected period of time or may be in a series of spaced doses. Both local and systemic administration is contemplated.

One or more suitable unit dosage forms having the therapeutic agent(s) of the invention, which, as discussed below, may optionally be formulated for sustained release (for example using microencapsulation), can be administered by a variety of routes including parenteral, including by intravenous and intramuscular routes, as well as by direct injection into the diseased tissue. The formulations may, where appropriate, be conveniently presented in discrete unit dosage forms and may be prepared by any of the methods well known to pharmacy. Such methods may include the step of bringing, into association the therapeutic agent with liquid carriers, solid matrices, semi-solid carriers, finely divided solid carriers or combinations thereof, and then, if necessary, introducing or shaping the product into the desired delivery system.

When the therapeutic agents of the invention are prepared for administration, they are preferably combined with a pharmaceutically acceptable carrier, diluent or excipient to form a pharmaceutical formulation, or unit dosage form. The total active ingredients in such formulations include from 0.1 to 99.9% by weight of the formulation. A "pharmaceutically acceptable" is a carrier, diluent, excipient, and/or salt that is compatible with the other ingredients of the formulation, and not deleterious to the recipient thereof. The active ingredient for administration may be present as a powder or as granules, as a solution, a suspension or an emulsion.

Pharmaceutical formulations containing the therapeutic agents of the invention can be prepared by procedures known in the art using well known and readily available ingredients. The therapeutic agents of the invention can also be formulated as solutions appropriate for parenteral administration, for instance by intramuscular, subcutaneous or intravenous routes.

The pharmaceutical formulations of the therapeutic agents of the invention can also take the form of an aqueous or anhydrous solution or dispersion, or alternatively the form of an emulsion or suspension.

Thus, the therapeutic agent may be formulated for parenteral administration (e.g., by injection, for example, bolus injection or continuous infusion) and may be presented in unit dose form in ampules, pre-filled syringes, small volume infusion containers or in multi-dose containers with an added preservative. The active ingredients may take such forms as suspensions, solutions, or emulsions in oily or aqueous vehicles, and may contain formulatory agents such as suspending, stabilizing and/or dispersing agents. Alternatively, the active ingredients may be in powder form, obtained by aseptic isolation of sterile solid or by lyophilization from solution, for constitution with a suitable vehicle, e.g., sterile, pyrogen-free water, before use.

It will be appreciated that the unit content of active ingredient or ingredients contained in an individual aerosol dose of each dosage form need not in itself constitute an effective amount for treating the particular indication or disease since the necessary effective amount can be reached by administration of a plurality of dosage units. Moreover, the effective amount may be achieved using less than the dose in the dosage form, either individually, or in a series of administrations.

The pharmaceutical formulations of the present invention may include, as optional ingredients, pharmaceutically acceptable carriers, diluents, solubilizing or emulsifying agents, and salts of the type that are well-known in the art. Specific non-limiting examples of the carriers and/or diluents that are useful in the pharmaceutical formulations of the present invention include water and physiologically acceptable buffered saline solutions such as phosphate buffered saline solutions pH 7.0-8.0, saline solutions, and water.

Example 1

The incidence of multiple organ dysfunction syndrome (MODS) and the related acute respiratory distress syndrome (ARDS) in critically ill patients is as high as 25% with a mortality of more than 40%. Those patients that do survive often have significant morbidity and prolonged hospitalization and the associated financial burdens. There are several etiologies of MODS/ARDS including trauma, sepsis, burns, ischemia/reperfusion, and acute lung injury (ALI). However, even with identification of high risk patients, there are no effective treatments to prevent the development of these syndromes.

The hypothesis that extracellular histones mediate tissue injury is a relatively new concept. Histones represent one of many damage-associated molecular pattern molecules that can initiate and perpetuate immune response. Their potential to amplify tissue injury by killing other cells, in addition to their agonistic activity on TLRs, provides strong rationale to target histones for therapy. Since histories (cationic proteins) normally associate with DNA in the nucleosome, oligonucleotides (anionic molecules) have extraordinarily high affinity and specificity for histones, making them the preferred reagent for binding and neutralizing circulating histones. RNA aptamers are designed to selectively target and neutralize circulating histones. RNA aptamers are single-stranded oligonucleotides whose binding properties depend on their sequence and structure. Aptamers have significant advantages over other biologics, including stability at room temperature, resistance to serum degradation, and minimal immunogenicity. By using chemically modified RNA, the aptamers are protected from serum degradation and immunogenicity.

Furthermore, alternative approaches to inhibit histone-mediated cellular injury have major limitations. First, while TLRs clearly mediate the immune response induced by histories, they have no role in histone dependent, calcium-mediated cytotoxicity, negating the use of TLR neutralizing antibodies. Second, several other biologics that demonstrate efficacy in animal models have tailed to provide a therapeutic benefit in clinical trials or have increased risk of bleeding or toxicity. In addition, many biologics require special handling and storage, special dosing considerations, and risk allergic reactions (e.g. recombinant proteins and antibodies). The development of RNA aptamer inhibitors of histone-mediated injury is a unique clinical opportunity to interrupt a self-propagating cascade responsible for significant morbidity and mortality.

MODS is described as "the development of potentially reversible physiologic derangement involving two or more organ systems not involved in the disorder that resulted in ICU admission, and arising in the wake of a potentially life-threatening physiologic insult". (Holzheimer R G, Mannick J A, Marshall J C. The multiple organ dysfunction syndrome. 2001) With the lungs being the organ most commonly involved, acute lung injury (ALI) and acute respiratory distress syndrome (ARDS) may be the primary and most clinically relevant presentation. The annual incidence of ALI/ARDS approximates 200,000 cases in the United States, with mortality approaching 40%. (Bosmann M, Grailer J J, Ruemmler R, Russkamp N F, Zetoune F S, Sarma J V, Standiford T J, Ward P A. Extracellular histones are essential effectors of c5ar- and c512-mediated tissue damage and inflammation in acute lung injury. *The FASEB Journal*, 2013; 27:5010-5021). Despite extensive research into the pathogenesis of ALI and clinical trials testing new therapeutics, the improvement in outcomes following ARDS over the past decade are due to improved strategies of mechanical ventilation and advanced support of other failing organs, as there remains no effective pharmacotherapy to treat patients with this syndrome. Furthermore, patients who survive frequently have significant psychological and physical morbidity, residual physical limitations and poor quality of life. The development of ALI/ARDS occurs as a consequence of critical illness of diverse etiologies including initial major trauma, toxic inhalation, burns, near-drowning, radiation, sepsis, and blood transfusion. Furthermore, another common manifestation of MODS is haemostatic abnormalities ranging from subclinical activation of blood coagulation (hypercoagulability) to acute disseminated intravascular coagulation (DIC) and subsequent consumption of platelets and coagulation proteins causing bleeding.

Recent evidence suggests that there may be a shared molecular mechanism responsible for the self-propagating tissue injury associated with these diverse conditions when they progress to MODS, and that involves extracellular histones. Eukaryotic genomes are organized in chromatin, a DNA-protein complex whose basic repeating unit is the nucleosome. The nucleosome consists of DNA wrapped around an octamer of histone proteins (two each of histones H2A, H2B, H3, and H4). (Allam R, Kumar S V, Darisipudi M N, Anders H-J. Extracellular histones in tissue injury and inflammation. *Journal of Molecular Medicine.* 2014; 92:465-472). However, severely injured tissues release large quantities of nucleosomes into the circulation, which are further broken down into individual histones. Elevated levels of circulating histones can be derived either from damaged and apoptotic cells or front the degradation of neutrophil extracellular traps (NETs), which are structures of extracellular histones and DNA that ensnare and kill bacteria. (Thomas G M, Carbo C, Curtis B R, Martinod K, Mazo I B, Schatzberg D, Cifuni S M, Fuchs T A, von Andrian U H, Hartwig J H. Extracellular DNA traps are associated with the pathogenesis of trali in humans and mice. *Blood,* 2012; 119:6335-6343). In critically ill patients, an increase in histone levels within 6 hours of admission predicts mortality. Similarly, in patients with major trauma, circulating histones levels correlate with injury severity, are elevated by 4 hours and peak at about 24 hours after trauma and are still detectable at 72 hours. (Abrams S T, Zharig N, Manson J, Liu T, Dart C, Baluwa F, Wang S S, Brohi K, Kipar A, Yu W. Circulating histones are mediators of trauma-associated lung injury. *American journal of respiratory and critical care medicine.* 2013; 187:160-169).

The present invention provides a therapeutic to rapidly neutralize circulating histones and terminate the self-propagating cycle of tissue injury and development of MODS/ARDS. As indicated by its function in the nucleosome, the ideal reagent to bind histones (highly cationic proteins) is an oligonucleotide (anionic DNA or RNA molecule). An innovative technology is used to identify short oligonucleotides (RNA aptamers) that selectively bind to histones known to cause MODS/ARDS. Since histones are highly conserved across species from yeast to humans, the bio-reagents developed and validated are quickly advanced for testing in preclinical models and human clinical trials.

Several lines of evidence have substantiated that circulating histones, not nucleosomes or DNA, mediate these toxic effects. For example, nucleosomes which have been briefly sonicated or exposed to serum (i.e., DNA is degraded and individual histones are released) induce endothelial cell death. (Allam R, Kumar S V, Darisipudi M N, Anders H-J. Extracellular histones in tissue injury and inflammation. *Journal of Molecular Medicine,* 2014; 92:465-472). Human patient serum with histone levels in excess of 50 µg/ml is toxic to cultured endothelial cells. (Abrams S T, Zhang N, Manson J, Liu T, Dart C, Baluwa F, Wang S S, Brohi K, Kipar A, Yu W. Circulating histones are mediators of trauma-associated lung injury. *American journal of respiratory and critical care medicine,* 2013; 187:160-169). Intravenous injection of recombinant histones in mice causes endothelial damage, cytokine elevation, platelet aggregation, and microvascular necrosis in the lungs, leading to death. (Abrams S T, Zhang N, Manson J, Liu T, Dart C, Baluwa F, Wang S S, Brohi K, Kipar A, Yu W. Circulating histones are mediators of trauma-associated lung injury. *American journal of respiratory and critical care medicine,* 2013; 187:160-169; Xu J, Zhang X, Pelayo R, Monestier M, Ammollo C T, Semeraro F, Taylor F B, Esmon N L, Lupu F, Esmon C T, Extracellular histones are major mediators of death in sepsis. *Nature medicine,* 2009; 15:1318-1321). Extracellular histones mediate tissue damage through multiple mechanisms including: (1) disruption of cell membranes, resulting in $Ca^{2+}$ influx and subsequent elevations in intracellular $Ca^{2+}$ concentrations and cell damage; (2) activation of TLR2 and TLR4, thereby inducing NF-κB and pro-inflammatory cytokine production; (3) induction of a pro-coagulant phenotype in platelets, thereby accelerating blood coagulation and enhancing thrombin generation in a mechanism that involves Toll like receptors (TLR) 2 and 4 (Semeraro F, Ammollo C T, Morrissey J H, Dale G L, Friese P, Esmon N L, Esmon C T. Extracellular histones promote thrombin generation through platelet-dependent mechanisms: Involvement of platelet tlr2 and tlr4. *Blood,* 2011; 118:1952-1961); (4) increased gut permeability, which allows endotoxin or bacteria to enter the circulation and prime neutrophils which, in turn, release toxic mediators (i.e., cytokines) to damage lungs and other organs.

Current attempts to abrogate histone-induced injury have limitations. Histories represent one of many damage-associated molecular pattern molecules that can initiate and perpetuate immune response; their potential to amplify tissue injury by killing other cells, in addition to their agonistic activity on TLRs, provides a rationale to target histones for therapy. Unfortunately, approaches currently being pursued in experimental models have marked limitations. First, while TLRs clearly mediate the immune response induced by histones, they have no role in calcium-mediated cytotoxicity, negating the use of TLR2/4 neutralizing antibodies. Second, several other biologics that demonstrated efficacy in animal models have failed to provide a therapeutic benefit in clinical trials (activated protein C) or have increased risk of bleeding (heparin, APC) or toxicity (histone deacetylase inhibitors). In addition, many biologics require special handling and storage, special dosing considerations, and risk allergic reactions (e.g., recombinant proteins and antibodies). Given the limitations of current approaches, the development of selective inhibitors of histone-mediated injury is a unique clinical opportunity to interrupt a pathophysiologic cascade responsible for significant morbidity and mortality.

The ideal binding partner of a histone (cationic protein) is an oligonucleotide (anionic molecule). Histones normally associate with DNA in the nucleosome. Given their strong negative charge, oligonucleotides (e.g. RNA aptamers) have extraordinarily high affinity and specificity for positively charged histones, making them the preferred reagent for binding and neutralizing circulating histones. No one has previously attempted to use oligonucleotides to inhibit extracellular histones. RNA aptamers are single-stranded nucleic acids whose binding properties depend on their sequence and structure.

Development and In Vitro Characterization of RNA Aptamers that Selectively Bind to Human Histones.

SELEX is used to identify RNA aptamers with high affinity to human H3 and H4. Studies characterize individual aptamer sequences and define their binding affinity and specificity. (Tuerk C, Gold L. Systematic evolution of ligands by exponential enrichment: RNA ligands to bacteriophage t4 DNA polymerase. *Science,* 1990249:505-510). Studies also use cultured human pulmonary endothelial cells, alveolar epithelial cells, and platelets to confirm the efficacy of RNA aptamers at neutralizing histone-mediated cellular effects.

A. Development of RNA Aptamers to Human Histones H3 and H4.

These studies identify RNA aptamers that selectively bind with high affinity to both human histones H3/H4. Briefly, RNA aptamers with specificity for human H3 and H4 were enriched by pre-clearing a chemically modified RNA aptamer library against control proteins (BSA and human IgG) abundant in serum. Those RNAs that did not bind serum proteins were collected and incubated with either human H3 or H4. Histone-bound RNAs were collected and processed for the next round of selection. Several rounds of selection were performed to enrich for high affinity binders. High affinity aptamers were enriched by modifying the selection conditions at each round of selection (e.g. increasing the RNA:histone ratio during the positive selection step and reducing the incubation time of aptamers with histones H3/H4).

Figure 3A:
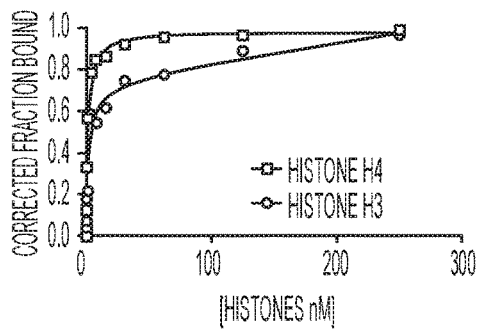
FIGS. 3A-3B. Binding of RNA aptamers to histone H3 and H4 proteins. (A) Binding affinities of H3/H4 to unselected RNA aptamer library as determined by a dot blot filter binding assay. H3 KD=2.1 nM; H4 $K_D$=1.5 nM. (B) Binding affinities of histone H3 to unselected RNA aptamer library (R0) and selected RNA aptamer pools from rounds 2, 4, 6, and 7 of selection were determined as in part A. A leftward shift in binding is indicative of enrichment for higher affinity aptamers. $K_D$ for rounds 6 (RD6) and 7 (RD7)=~0.3 nM.
Figure 3B:
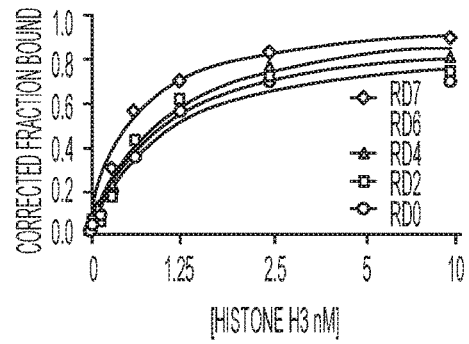

It has been confirmed that the starting, unenriched RNA aptamer library (round 0) binds to the histone proteins with low nM affinity (FIG. 3A). Following seven rounds of selection RNA sequences were enriched with overall higher affinity (high pM range) for the intended histone target (FIG. 3B) (data shown for H3 selection). Finally, round 7 from each selection did not bind to proteins normally found in serum (data not shown), confirming the specificity of the selected RNAs. After 8-10 rounds of selection, final post-selection, enriched aptamer pool has affinities in the low pM range. The progress of the selections are assessed by determining the sequence diversity of the random regions from round to round by high-throughput sequencing (HTS) and identifying sequence and structure families using bioinformatics analyses. Progress of the selections is assessed by carrying out standard in vitro binding assays with the pools of RNA from each round.

B. In Vitro Characterization of Individual RNA Aptamers.

Individual RNA aptamers identified from the sequence analysis are screened for (1) specificity of binding and for (2) ability to inhibit historic activity. In vitro filter binding assays are performed with the top 10-15 sequences from the FITS and bioinformatics analysis as previously described. (Thiel K W, Hernandez L I, Dassie J P, Thiel W H, Liu X, Stockdale K R, Rothman A M, Hernandez F J, McNamara J O, 2nd, Giangrande P H. Delivery of chemo-sensitizing siRNAs to her2+-breast cancer cells using RNA aptamers, *Nucleic Acids Res.* 2012; 40; 6319-6337; Thiel W H, Bair T, Peek A S, Liu X, Dassie J, Stockdale K R, Behlke M A, Miller F J, Jr., Giangrande P H. Rapid identification of cell-specific, internalizing RNA aptamers with bioinformatics analyses of a cell-based aptamer selection. *PLoS One,* 2012; 7:e43836; Thiel W H, Bair T, Wyatt Thiel K, Dassie J P, Rockey W M, Howell C A, Liu X Y, Dupuy A J, Huang L, Owczarzy R, Behlke M A, McNamara J O, Giangrande P H. Nucleotide bias observed with a short SELEX RNA aptamer library. *Nucleic Acid Ther.* 2011; 21:253-263). A more extensive quantitative determination of binding affinities via surface plasmon resonance (SPR) is performed for the 5 aptamers that demonstrate the greatest affinity and specific binding in the filter binding assays (Thiel K W, Hernandez L I, Massie J P, Thiel W H, Liu X, Stockdale K R, Rothman A M, Hernandez F J, McNamara J O, 2nd. Giangrande P H. Delivery of chemo-sensitizing siRNAs to her2+-breast cancer cells using RNA aptamers. *Nucleic Acids Res.* 2012; 40:6319-6337; Huang Y Z, Hernandez F J, Gu B, Stockdale K R, Nanapaneni K. Scheetz T E, Behlke M A, Peek A S, Bair T, Giangrande P H, McNamara J O, 2nd. RNA aptamer-based functional ligands of the neurotrophin receptor, trkb. *Mol Pharmacol.* 2012; 82:623-635; Hernandez L I, Flenker K S, Hernandez F J, Klingelhutz A J, McNamara J O, 2nd, Giangrande P H. Methods for evaluating cell-specific, cell-internalizing RNA aptamers. *Pharmaceuticals (Basel).* 2013; 6:295-319). The best two candidate aptamers that selectively bind H3/H4 in the low pM-low nM range are used to test efficacy in cells in culture. Mutated aptamers that have weak-to-no affinity for histones serve as negative controls. Cells also receive aptamers without histones as a control. To model circulating histone content, human, pulmonary microvascular endothelial cells (EC), human alveolar epithelial cells, or human platelets are exposed to histones purified from calf thymus[5, 7] (contains a heterogeneous mixture of core histones) (Abrams S T, Zhang N, Manson J, Liu T, Dart C, Baluwa F, Wang S S, Brohi K, Kipar A, Yu W. Circulating histones are mediators of trauma-associated lung injury. *American journal of respiratory and critical care medicine.* 2013; 187:160-169; Semeraro F, Ammollo C T, Morrissey J H, Dale G L, Friese P, Esmon N L, Esmon C T. Extracellular histones promote thrombin generation through platelet-dependent mechanisms: Involvement of platelet tlr2 and tlr4. *Blood,* 2011; 118:1952-1961) in the presence or absence of aptamer. Human patient serum with histone levels in excess of 50 µg/ml is toxic to EC (Abrams S T, Zhang N, Manson J, Liu T, Dart C, Baluwa F, Wang S S, Brohi K, Kipar A, Yu W. Circulating histones are mediators of trauma-associated lung injury. *American journal of respiratory and critical care medicine.* 2013; 187:160-169; Xu J, Zhang X, Pelayo R, Monestier M, Ammollo C T, Semeraro F, Taylor F B, Esmon N L, Lupu F, Esmon C T. Extracellular histories are major mediators of death in sepsis. *Nature medicine,* 2009; 15:1318-1321)); therefore this concentration is used in vitro. Dose response curves for the aptamers are determined in vitro and will define the concentration used in in vivo studies. Studies also explore timing of aptamer delivery, in particular if treatment after exposure to circulating histones can prevent cellular toxicity. Cellular toxicity is determined by performing the following measurements: (1) Measurement of calcium influx: Intracellular calcium concentration, will be measured using established protocols with fura 2-AM as the fluorescent probe. (2) Measurement of TLR activation: Expression of IFN-γ, IL-1β, IL-6, and TNF-α will be assessed by PCR. (3) Detection of cell toxicity: Live, apoptotic, and dead cells are determined by flow cytometry following staining with annexin-V and propidium iodide (PI). (4) Measurement of transcellular resistance: Transendothelial and transepithelial electrical resistance is measured across a confluent monolayer using an electrical cell-substrate impedance sensing system.

Figure 4A:
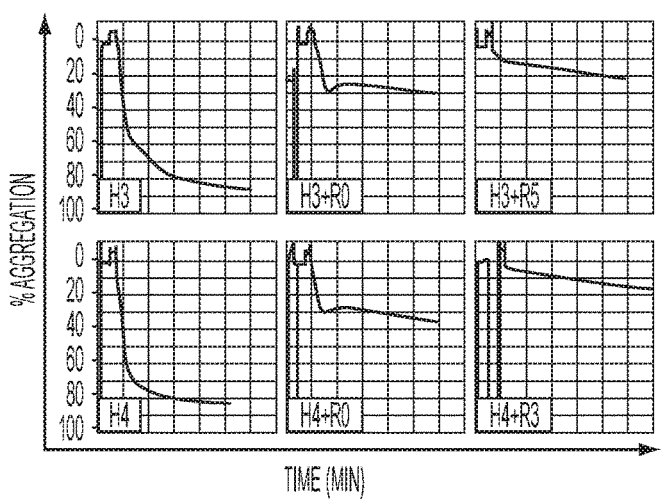
FIGS. 4A and 4B. RNA aptamers inhibit histone-mediated platelet aggregation. Platelet aggregation was performed with washed human platelets and quantitated using an aggregometer at 2 min intervals. (A) Histones H3 (50 mg/mL—top row) and H4 (10 mg/mL—bottom row) induce platelet aggregation. Addition of the unselected round 0 (R0) aptamer pool (10 nM) reduces platelet aggregation. A more pronounced inhibition of platelet aggregation is observed with selected RNA pools (R5 for H3 and R3 for H4). (B) RNA aptamers have no effect on collagen-mediated platelet aggregation (top panels). As a positive control, heparin (1 U/mL) reverses histone-mediated platelet aggregation (data shown for histone H4).
Figure 4B:
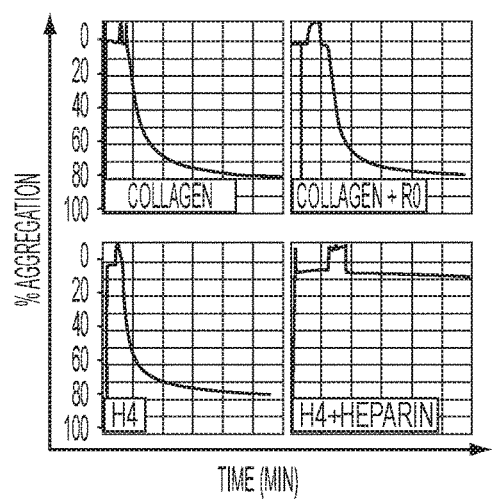

Platelet aggregation: The release of histones from dying cells is associated with microvascular thrombosis. Histone H3 and H4 have been found to be responsible for directly inducing aggregation of human platelets. As an independent measure of aptamer inhibition of histone activity, the effect of individual histone, aptamers is evaluate on historic-mediate platelet aggregation. (Xu J, Zhang X, Pelayo R, Monestier M, Ammollo C T, Semeraro F, Taylor F B, Esmon N L, Lupu F, Esmon C T. Extracellular histories are major mediators of death in sepsis. *Nature medicine,* 2009;

15:1318-1321). It has been shown that histones H3/H4 induce pronounced platelet aggregation which can be inhibited with addition of RNA aptamers (FIG. 4A). Importantly, aptamer inhibition of histone-mediated aggregation was more pronounced with selected aptamer pools (R5 pool for H3; R3 pool for H4) compared to the unselected RNA pool (R0). As a measure of specificity, the RNA aptamers did not reverse collagen-mediated platelet aggregation (FIG. 4B). For these studies, blood is collected from human volunteers, platelet-rich plasma prepared, and platelets isolated. Using the histone and aptamer treatment protocol described above, studies are performed in a collagen-coated flow chamber perfused with washed human platelets as previously described. (Xu J, Zhang X, Pelayo R, Monestier M, Ammollo C T, Semeraro F, Taylor F B, Esmon N L, Lupu F, Esmon C T. Extracellular histones are major mediators of death in sepsis. *Nature medicine,* 2009; 15:1318-1321). In separate studies, platelet surface marker expression (activated α2bβ3 and P-selectin) are detected by fluorescent antibodies followed by flow cytometry.

Evaluate Efficacy and Safety of Histone-Specific RNA Aptamers In Vivo.

The efficacy of the histone specific aptamers in mouse models of MODS/ARDS, TRALI, and smoke inhalation is evaluated. Safety is evaluated in immune-competent mice and human peripheral blood mononuclear cells (PBMCs). Finally, efficacy in humans is evaluated by obtaining serum from critically ill patients and test the ability of aptamers to neutralize histone-mediated toxicity.

A. Animal Models of Disease:

These studies test the efficiency of the histone RNA aptamers in three independent mouse models of histone-induced lung injury (MODS/ARDS TRALI, inhalation lung injury). (Abrams S T, Zhang N, Manson J, Liu T, Dart C, Baluwa F, Wang S S, Brohi K, Kipar A, Yu W. Circulating histones are mediators of trauma-associated lung injury. *American journal of respiratory and critical care medicine.* 2013; 187:160-169; Ward P A, Grailer J J. Lung inflammation and damage induced by extracellular histones. *Inflammation and Cell Signaling,* 2014; 1; Chen R, Kang R, Fan X G, Tang D. Release and activity of histone in diseases. *Cell Death Dis.* 2014; 5:e1370). For each protocol, a control aptamer (mutant aptamer that has low-to-no affinity for histones) is administered and the H3 and H4-specific aptamers (one for each histone) is identified with the in vitro functional experiments as most effective at neutralizing histone-mediated toxicity. Aptamers are tested at different doses and administered at various times after the "injury". Animals are pretreated with the aptamers (0.1 mg/kg or 1 mg/kg, IV) at various times related to the injury to test the ability to prevent development or abort progression of tissue injury. The doses are adjusted as indicated based on the binding data to identify the lowest effective dose. In separate experiments, the aptamer is administered at various times after delivery of the histones (5, 15, and 30 minutes) to examine the ability of the aptamer to prevent injury after the presence of circulating histones. Noninvasive determination of respiratory function (reduced $O_2$ saturation) is continuously monitored using a pulse oximeter. After 3 h (or at the time of death if occurs prior to 3 h) the mice are sacrificed and the following performed: (1) Alveolar permeability and inflammation; Tracheas are isolated and cannulated and the lungs flushed with sterile PBS. Cytospins of BALF cells are stained with modified Wright-Giemsa. Alveolar permeability is assessed by quantitative detection of mouse albumin in BALF by ELISA. (2) Lung histology. Lungs are fixed, embedded and sectioned. Sections are stained with hematoxylin and eosin (H&E) and Mallory's phosphotungstic acid-hematoxylin staining for fibrin then examined by a pathologist for evidence of neutrophils in alveolar spaces, capillary congestion, intra-alveolar hemorrhage, fibrin deposits and thrombi. (3) TLR activation. Blood is collected and serum isolated and stored at −80° C. Cytokines/chemokines are all quantified using a customized multiplex magnetic bead panel kit. (4) Platelet FACS. Platelet surface marker expression (activated α2bβ3 and P-selectin) as a measure of platelet activation, are detected by fluorescent antibodies followed by flow cytometry.

Nonspecific Immune Activation:

Thorough studies are performed to evaluate any potential nonspecific immune effect of the histone RNA aptamers. For these studies, doses of the RNAs that are 10-fold greater than those found to be effective in vivo, are injected in the tail veins of C57/BL6 male mice. Blood from treated animals is collected by cardiac puncture at 1 h, 6 h and 12 h after the first administration of the RNA. Collected blood sera is analyzed using the Bio-Rad Bioplex platform to assess the levels of 23 different cytokines (Kaul R, Johnson K, Scholz H, Marr G. Performance of the bioplex 2200 autoimmun vasculitis kit. *Autoimmun Rev.* 2009; 8:224-227). Spleens and livers from treated mice will also are collected at early (0.5 hrs), intermediate (6 hrs), and late (24 hrs) time points following injection of the RNA and processed for total RNA. Levels of inflammatory cytokines, interferons and viral RNA recognition genes are quantified using RT-qPCR as previously described. (Dassie J P, Hernandez L I, Thomas G S, Long M E, Rockey W M, Howell C A, Chen Y, Hernandez F J, Liu X Y, Wilson M E. Targeted inhibition of prostate cancer metastases with an RNA aptamer to prostate-specific membrane antigen. *Molecular Therapy,* 2014). Polyinosinic:polycytidylic acid (Poly I:C) is used as a positive control for immune stimulation. Histological analysis of tissue sections is performed to determine if specific immune cell populations infiltrate specific tissues in response to RNA therapy. (Judge A D, Bola G, Lee A C, MacLachlan I. Design of non-inflammatory synthetic siRNA mediating potent gene silencing in vivo. *Mol Ther.* 2006; 13:494-505).

C. Obtain Serum from Critically Ill Patients and Test Ability of Aptamers to Neutralize Histone-Mediated Toxicity.

Blood samples are collected via initial placement of a 16 g or larger peripheral IV into citrated tubes after admission to the intensive care unit. Following centrifugation, control or histone targeting aptamers are added to the platelet-rich plasma. Platelets are isolated and surface marker expression (activated α2bβ3 and P-selectin) is detected by fluorescent antibodies followed by flow cytometry. The serum is added to cultured microvascular endothelial cells and toxicity measured as described above. Circulating histone levels are measured in the serum using an ELISA assay.

Example 2

Schematic of In Vitro SELEX Technology.

The DNA aptamer library contains a variable region of 20 bases flanked by two constant regions (FIG. 5): 1) The DNA template library is in vitro transcribed into RNA using a modified T7 RNA polymerase enzyme that enables the incorporation of chemically modified NTPs. 2) The RNA library is incubated with an irrelevant protein (control protein) for the preclear step to remove non-specific binders. 3) Those RNA aptamers that do not bind the control protein are then incubated with a target protein. 4) Unbound aptamers are removed and RNA aptamers bound to target protein are recovered, reversed transcribed using RT-PCR, 5) PCR amplified, and 6) in vitro transcribed in the presence of chemically modified NTPs (e.g. 2'-fluoro modified pyrimidines). Several rounds (2-10) are carried out to generate a library of aptamers with high affinity and specificity for the specific target.

Aptamer Inhibitors of Extracellular Histones for the Treatment of Sepsis.

Figure 6:
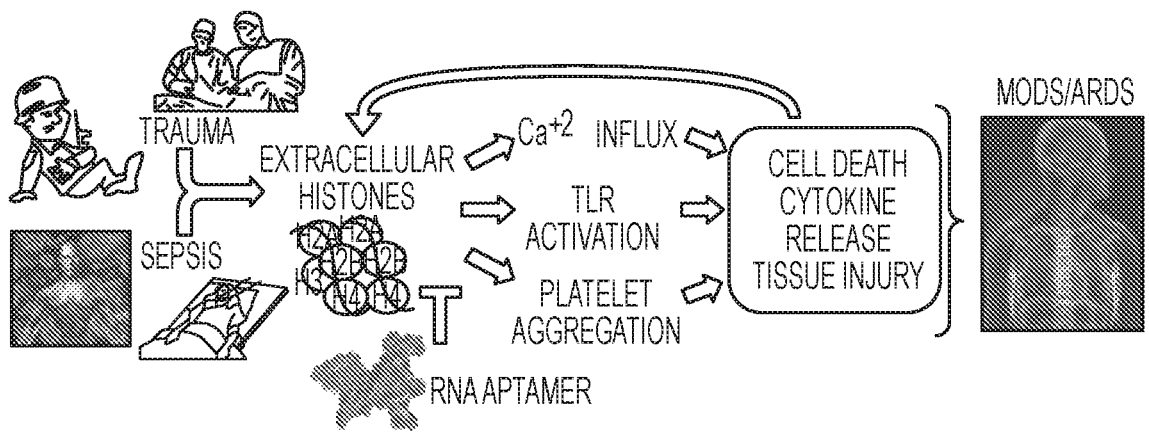
FIG. 6. Aptamer Inhibitors of Extracellular Histones for the Treatment of Critical Illness.

Tissue damage and diseases cause cells to release histones into the circulation (referred to as circulating or extracellular histones) (FIG. 6). The circulating histones go on to propagate release of more histones by the tissue injury and cell death.

Figure 7:
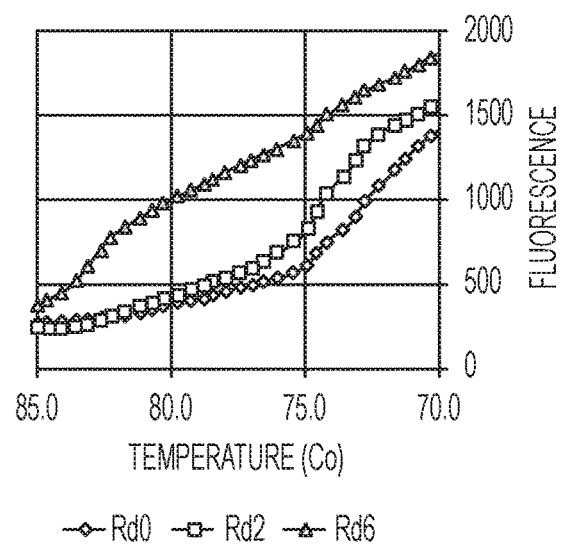
FIG. 7. Complexity assay.

Complexity Assay (FIG. 7).

A complexity assay was performed by mixing 10 µl of 0.5 µM DNA duplex library from selected rounds to 10 µl of SYBR green (BioRad, 170-8882). These samples were run in a 96 well plate on a real-time PCR machine (Eppendorf, Mastercycler epgradient S with realplex$^2$) using the gradient PCR protocol, 95° C. for 15 min; 95° C.-25° C. reducing the temperature every 15 sec.; 4° C. hold). The florescence from the raw data (performed in triplicate) was averaged then plotted as fluorescence intensity (SYBR) vs. temperature (C°). Reduction in complexity was shown by the relative shift of the DNA melt curve towards higher temperatures. DNA from Round 0 and H4 selected rounds 2 and 6 went through a reverse melt curve. Higher library complexity was seen in rounds 0 and 2 by a relative shift of the DNA melt curve towards lower temperatures, whereas, Round 6 shifted to a higher temperature indicating a lower library complexity.

Figure 8A:
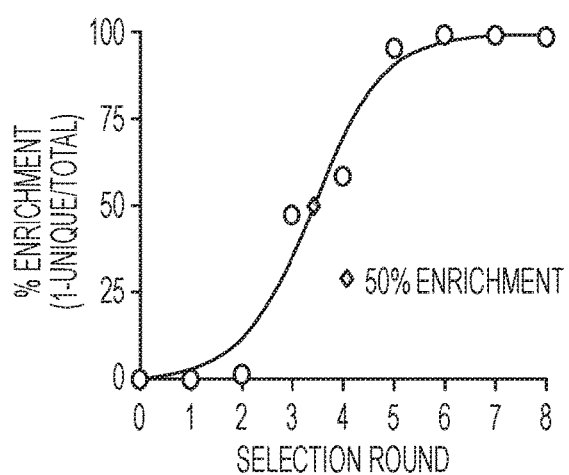
FIGS. 8A-8B. Sequence Enrichment data.
Figure 8B:
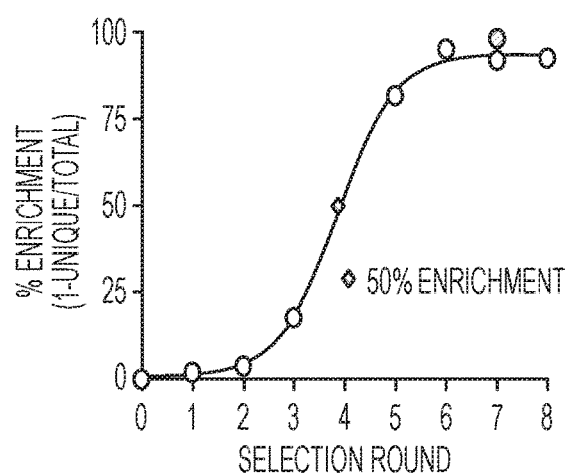

Sequence Enrichment of Aptamers for Histones (FIG. 8).

The sequence enrichment (% Enrichment) was determined for aptamers from the A) H3.2 and B) H4 aptamer selections. Sequence enrichment was determined for each round of selection (Selection Round) from read counts determined from Illumina sequencing using the following equation; % Enrichment-1-(unique sequences/total sequences). Unique sequences refers to the number of different sequences identified within a selection round and total sequences refers to the total number of reads from a selection round including all duplicate reads.

Figure 9A:
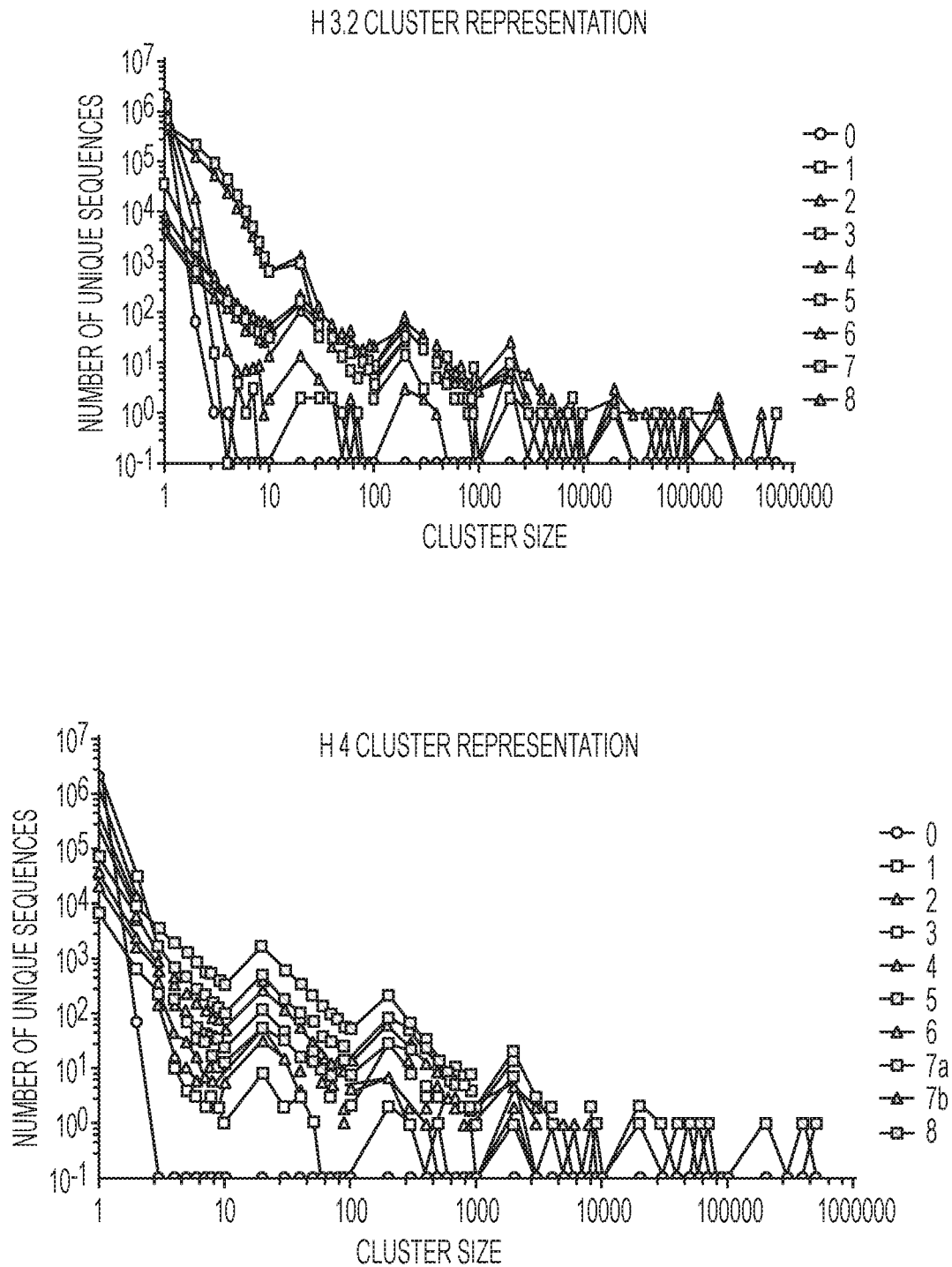

Separation of Non-Selected Aptamer Sequences from Selected Aptamer Sequences (FIGS. 9A-9B).

The A) read counts (Cluster Size) and B) round representation of H3.2 (left panels) and H4 (right panels) selection rounds (1-8) were compared to a pool of non-selected aptamers (round 0) to identify selected aptamers. Selected aptamers exhibit two properties, abundance and persistence. Selected aptamer will accumulate during the selection process (abundance) and the selected aptamers will appear in more than one selection rounds (persistence). The read count (Cluster Size) analysis examines aptamer abundance by plotting the distribution of read counts within each selection round of aptamer (rounds 0-8). The round representation analysis examines aptamer persistence by first determining the number of selection rounds each aptamer sequence was observed and second plotting the distribution of round representation for all aptamers within each selection round. Aptamers with read counts significantly greater than the read counts observed in round 0 (>4 reads) and that appear in at least two selection rounds are classified as selected.

Histone Aptamer Sequences (FIG. 10).

Figure 11:
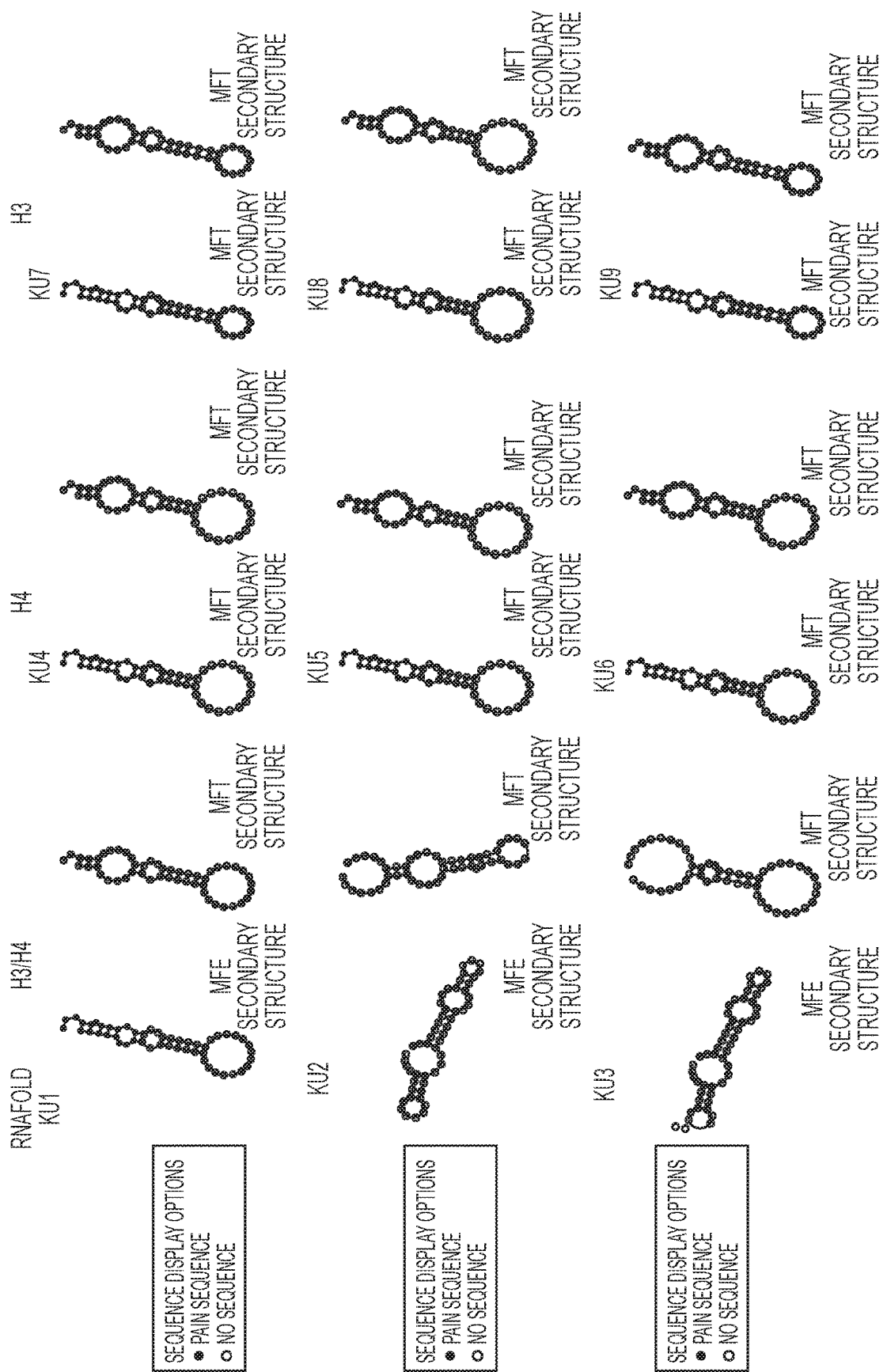
FIG. 11. Predicted secondary structure of selected aptamer sequences. Figure discloses KU1-KU9 structures as SEQ ID NOS 7598, 7619, 7620, 10754, 10749, 10765, 7741, 7832, and 7839, respectively.

These aptamers have read counts significantly greater than the read counts observed in round 0 (>4 reads) and that appear in at least two selection rounds are classified as selected. These nine aptamers had the largest Log 2 fold change between rounds 6:8. They were further selected by their presence in either both or one of the selections. The full list of selected aptamers is in Table 1 below, Predicted Secondary Structure of Selected Aptamer Sequences (FIG. 11).

The sequences from FIG. 10 were imputed into the RNA fold program to generate the possible secondary structures (Website: http://rna.tbi.univie.ac.at/cgi-bin/RNAfold.cgi)

Figure 12:
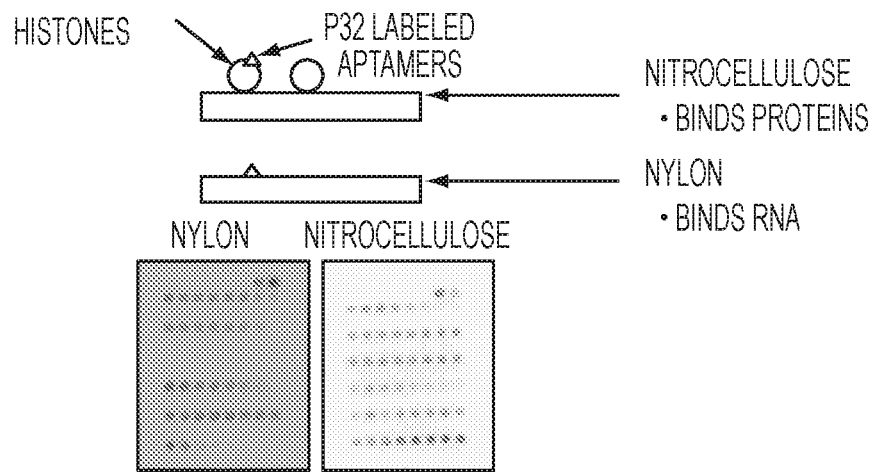
FIG. 12. Double-filter binding assay.

Filter Binding Assay Protocol (FIG. 12).

One hundred pmoles of purified RNA aptamers were dephosphorylated by Bacterial Alkaline Phosphatase (Promega) and were labeled with $^{32}$P-gamma ATP (6,000 Ci/mmol) by T4 PNK (Promega). The radiolabeled aptamers were then purified on G25 columns (GE Healthcare) and counted on a Scintillation Counter. The RNA amount was adjusted to 2,000 CPM/µl and folded by heating at 95° C. for 5 minutes, 65° C. for 5 minutes, and 37° C. for 10 minutes in the selected buffer. Serial dilutions of Histones starting from 250 nM were made in selection buffer. Five microliter of RNA was incubated with 15 µl of protein for 5 minutes at 37° C. filtered through Nitrocellulose (top) and Nylon (bottom) double-filters using dot-blot apparatus (Nalgene, Rochester, N.Y.). CL-X film was exposed by membranes for 30 minutes at RT and was imaged on the typhoon. ImageJ 1.38x software (Wayne Rasband; NIH, Bethesda, Md.) was used to determine relative optical density of radiographed spots in NC-filter binding assay, these data been used to calculate amount of radioactive RNA in each spot. (Wong I, Lohman T M. A double-filter method for nitrocellulose-filter binding: application to protein-nucleic acid interactions. Proc Natl Aad Sci USA 1993; 90: 5428-32.)

Figure 13A:
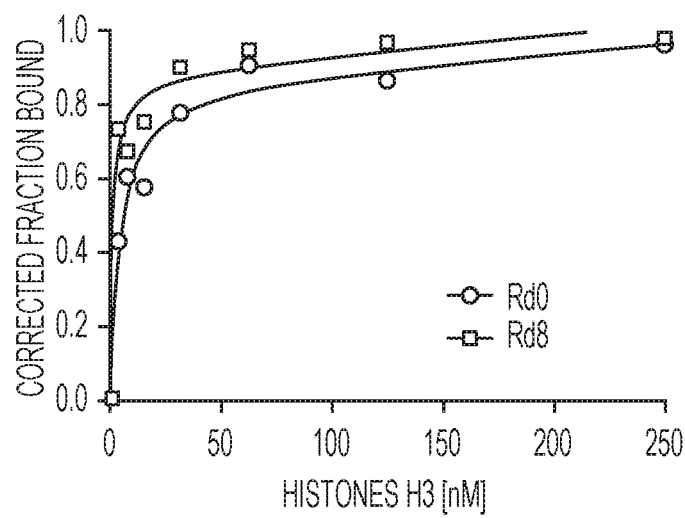
FIGS. 13A-13B. Binding data of rounds 0 and 8 of selection.
Figure 13B:
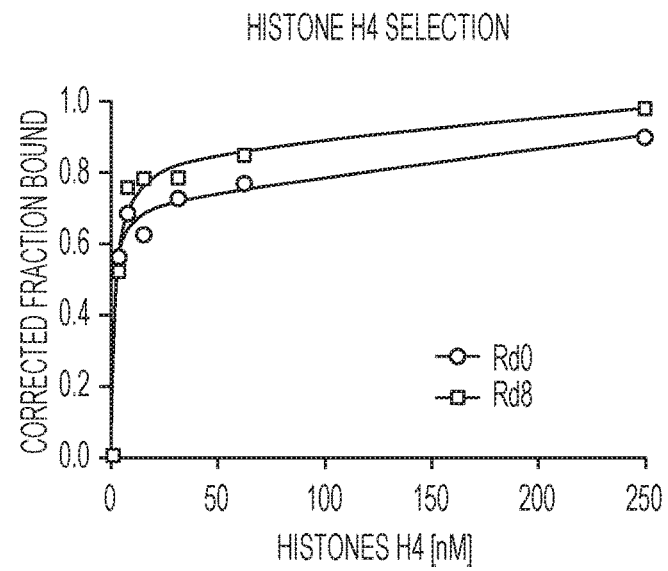

Progression of RNA Aptamer Selection for Histones H3 and H4 Measured by Filter Binding Assay (FIGS. 13A-13B).

Figure 14A:
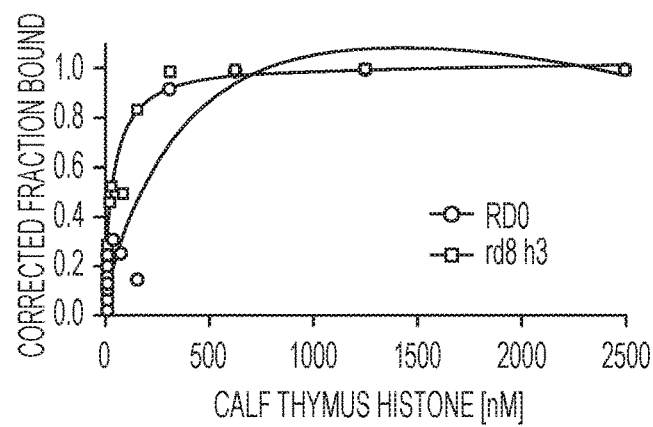
FIGS. 14A-14B. Binding data of rounds 0 and 8 of selection to calf thymus histones.
Figure 14B:
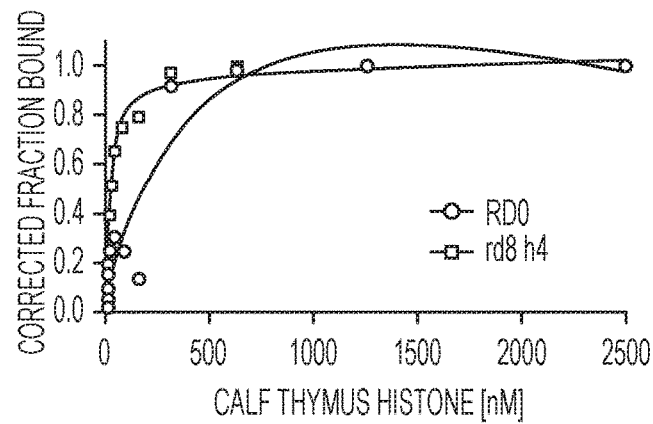

Binding of histone H3.2 (a) and histone H4 (B) to unselected RNA aptamer library (RD0) and selected RNA aptamer pool from round 8 of Selection (RD8). A leftward shift in binding is indicative of enrichment for higher affinity aptamers. H3 RD8 $K_D$=0.6 nM; H4 Rd8 $K_D$0.3 nM Binding Data of Rounds 0 and 8 of Selection to Calf Thymus Histones (FIGS. 14A-14B).

Binding of selected library (round 8-Rd8) and unselected library (RD0) to calf thymus histones was measured by filter binding assay as above. Rd8=squares; RD0=circles. Histone (calf thymus) is a natural mixture of the histones H1, H2A, H2B, H3 and H4. These histones still retain their posttranslational modifications.

Figure 2A:
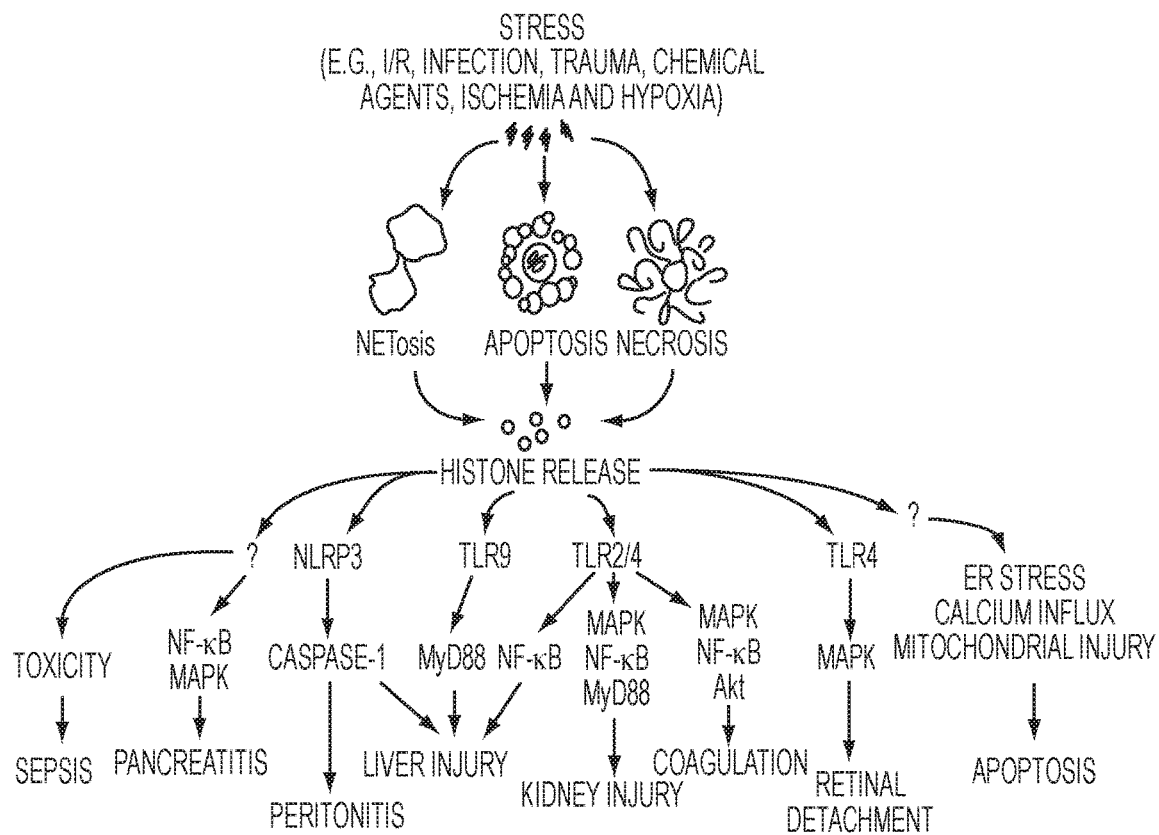
FIGS. 2A-2B. Extracellular histones mediate self-propagating diverse tissue injury.
Figure 2B:
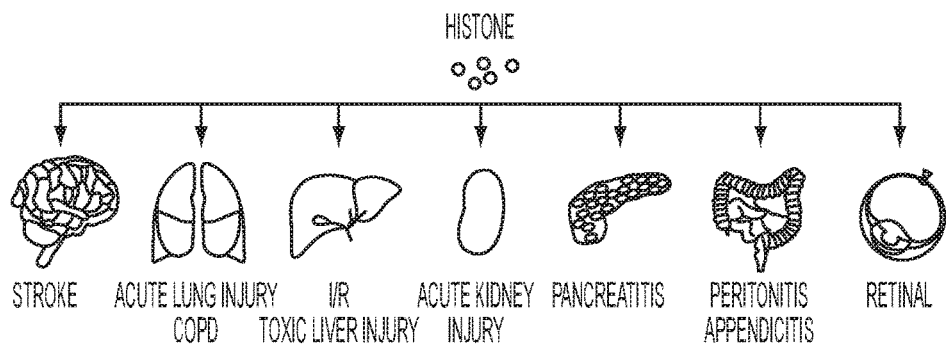
Figure 15A:
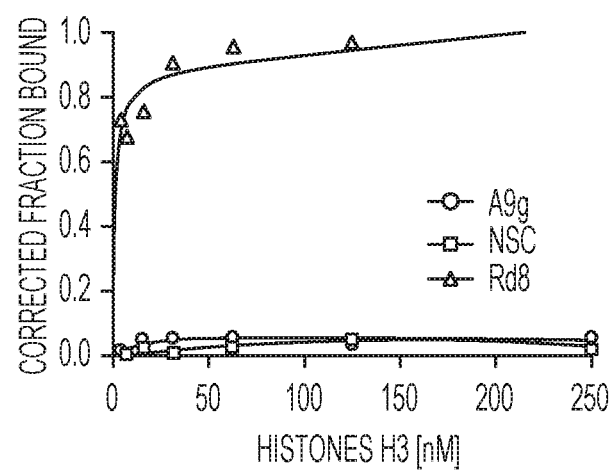
FIGS. 15A-15B. Binding specificity of selected round 8 RNA pool.
Figure 15B:
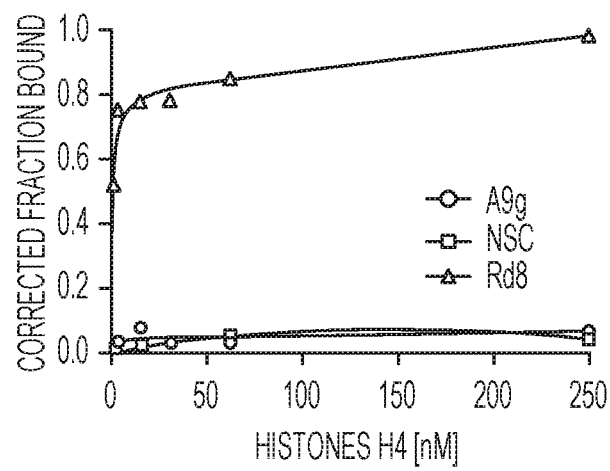
Figure 16A:
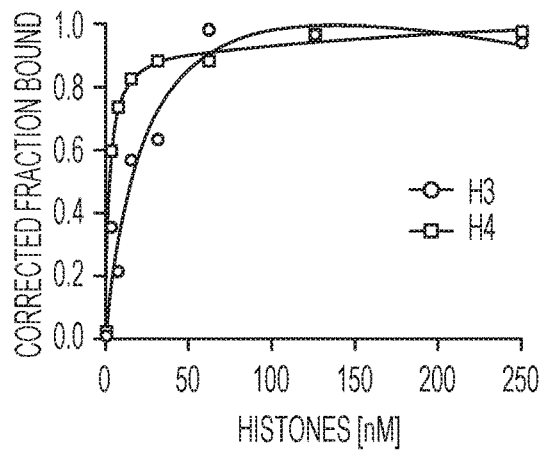
Figure 16B:
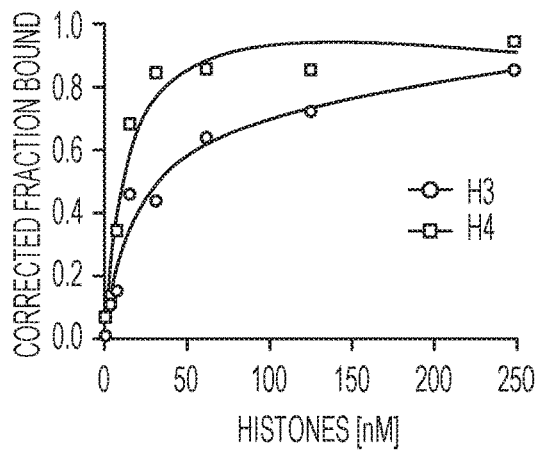
Figure 16C:
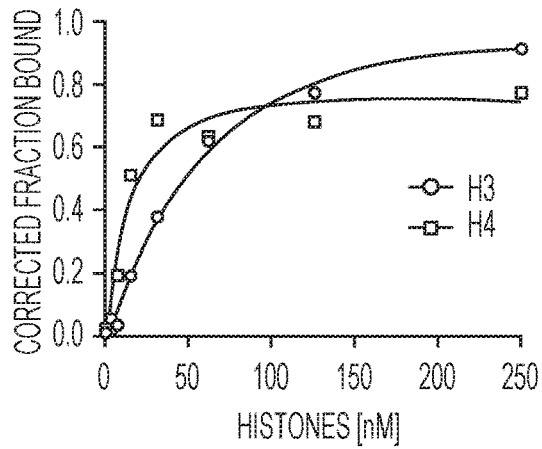
Figure 16D:
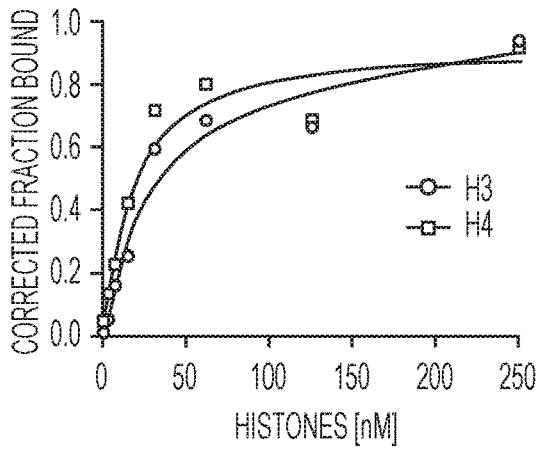
Figure 16E:
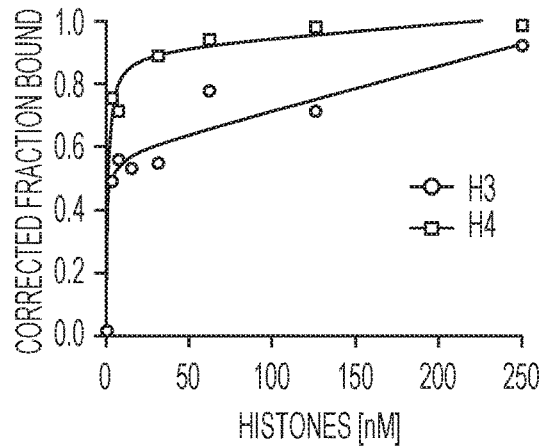
Figure 16F:
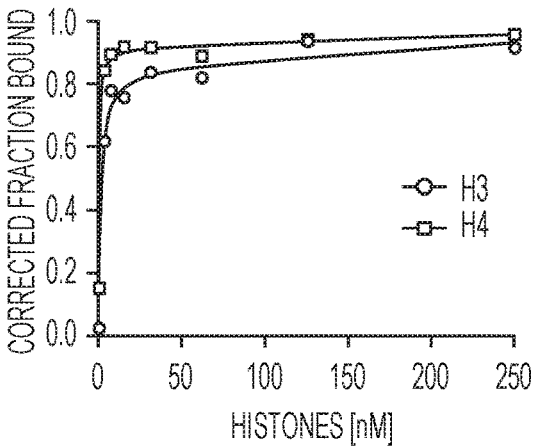
Figure 18A:
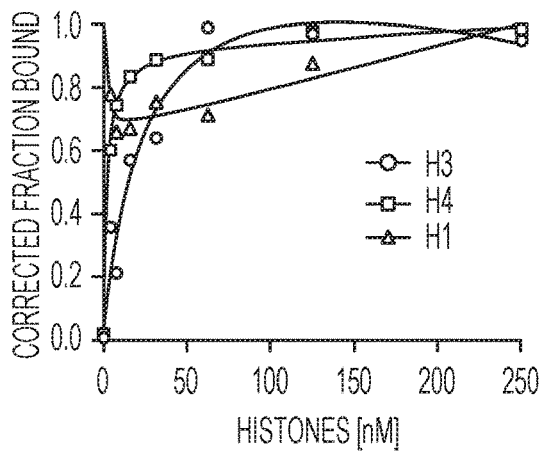
Figure 18B:
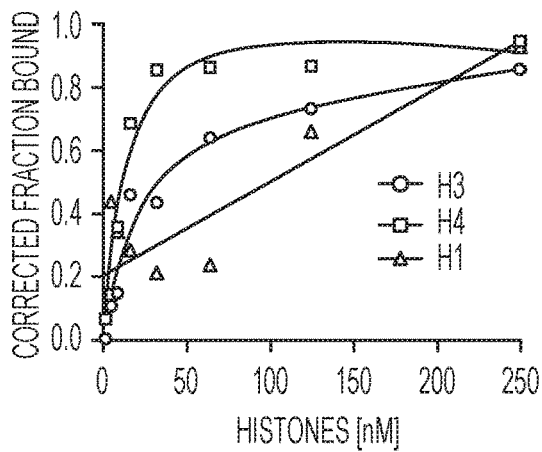
Figure 18C:
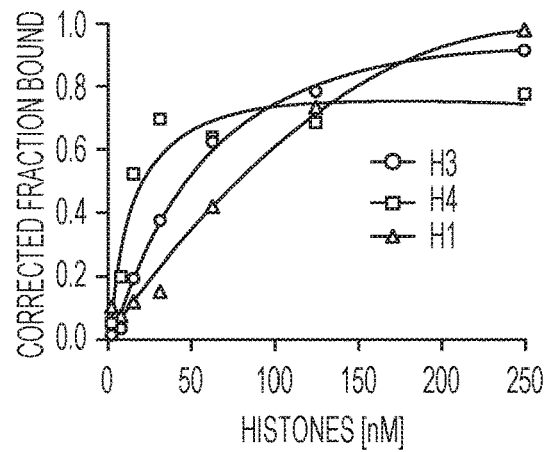
Figure 18D:
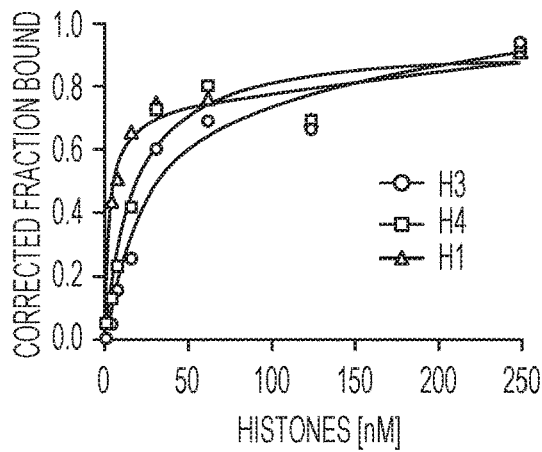
Figure 18E:
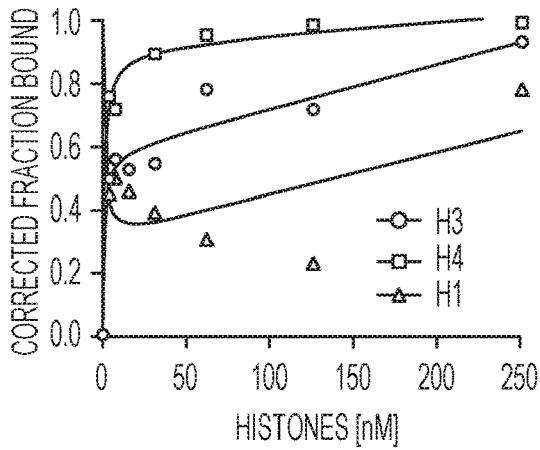
Figure 18F:
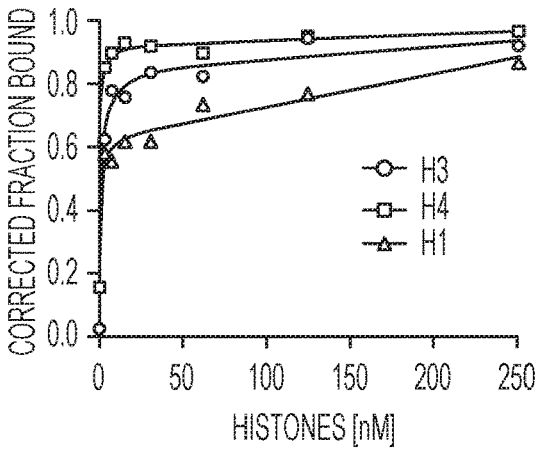
Figure 20A:
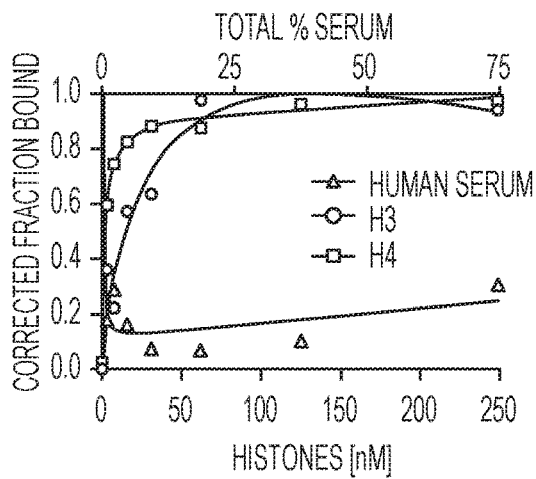
FIGS. 20A-20I. Binding data of individual RNA aptamers to histones H3 and H4, and human serum.
Figure 20B:
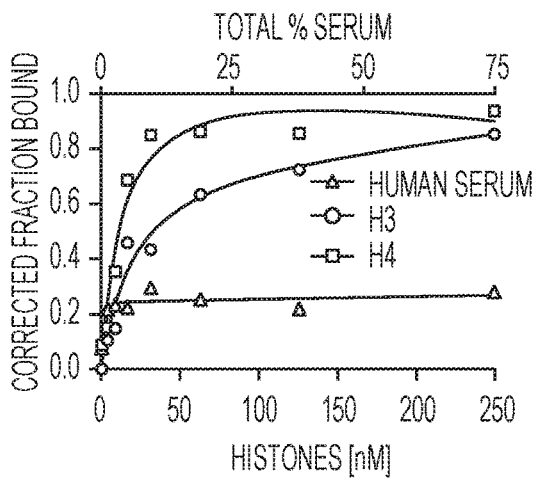
Figure 20C:
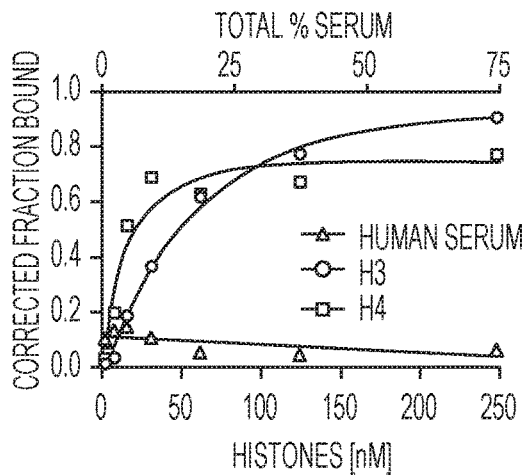
Figure 20D:
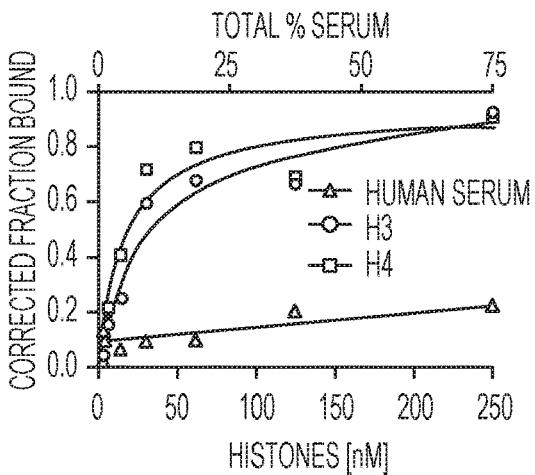
Figure 20E:
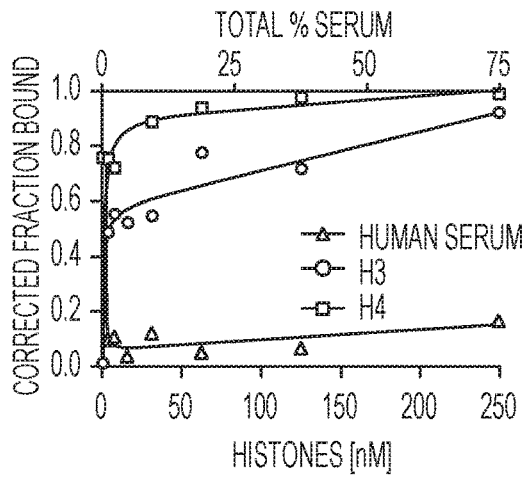
Figure 20F:
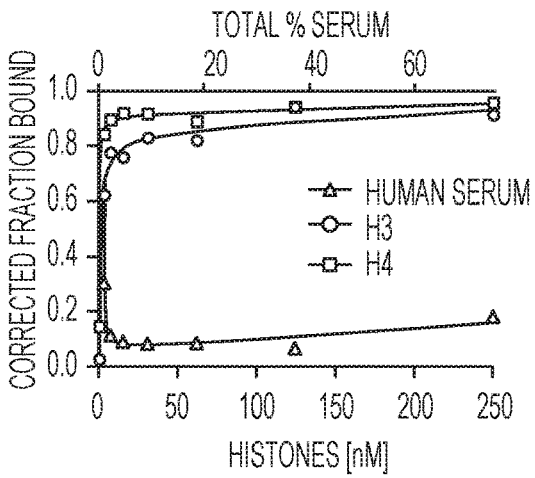
Figure 20G:
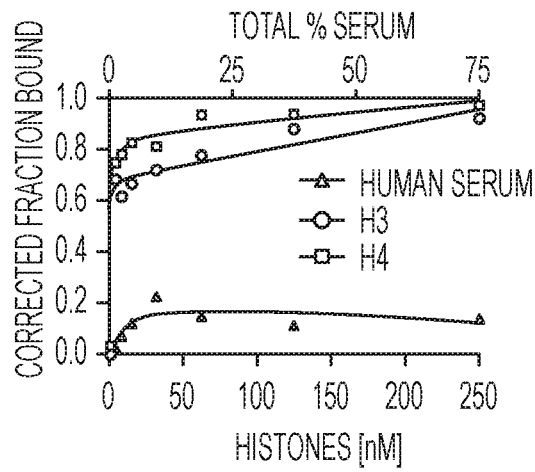
Figure 20H:
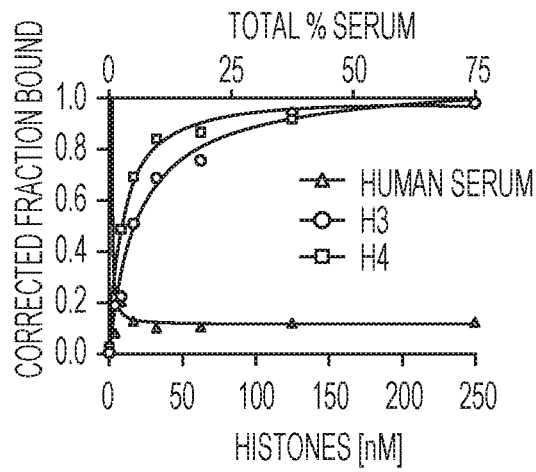
Figure 20I:
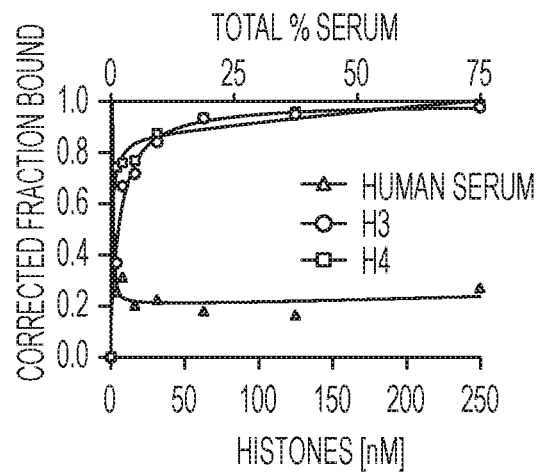

Binding Specificity of RNA Aptamers (FIGS. 15A-15B2).

Binding of selected library (round 8—Rd8) and control RNAs (NSC and A9g) to histones H3 and H4 was measured by filter binding assay as above. Rd8=triangles; NSC=squares; A9g=circles.

Binding of Individual RNA, Aptamers to Histone H3 and H4 Proteins (FIGS. 16A-16I).

Binding of aptamers KU1 (A), KU2 (B), KU3 (C), KU4 (D), KU5 (E), KU6 (F), KU 7 (G), KU 8 (H), KU 9 (1) to histones H3 (light circles) and H4 (dark squares) measured by filter binding assay.

Binding affinities ($K_D$) of the different clones in FIGS. 16A-16I for H4 and H3 (FIG. 17).

Binding of Individual RNA Aptamers to Histone H1, H3, and H4 Proteins (FIGS. 18A-18I).

Binding of aptamers KU1 (A), KU2 (B), KU 3 (C), KU4 (D), KU5 (E), KU6 (F), KU 7 (G), KU 8 (H), KU 9 (I) to histones H1 (triangles), H3 (light circles), and H4 (dark squares) measured by filter binding assay.

Binding Affinities ($K_D$) of the Different Clones in FIG. 4 for H1, H3 and H4 (FIG. 19).

Binding of individual RNA aptamers to histone H3, H4, and Human Serum (FIGS. 20A-20I).

Binding of aptamers KU1 (A), KU2 (B), KU 3 (C), KU4 (D), KU5 (E), KU6 (F), KU 7 (U), KU 8 (H), KU 9 (I) to Human Serum (triangles). H3 (light circles), and H4 (dark squares) measured by filter binding assay.

Figure 5:
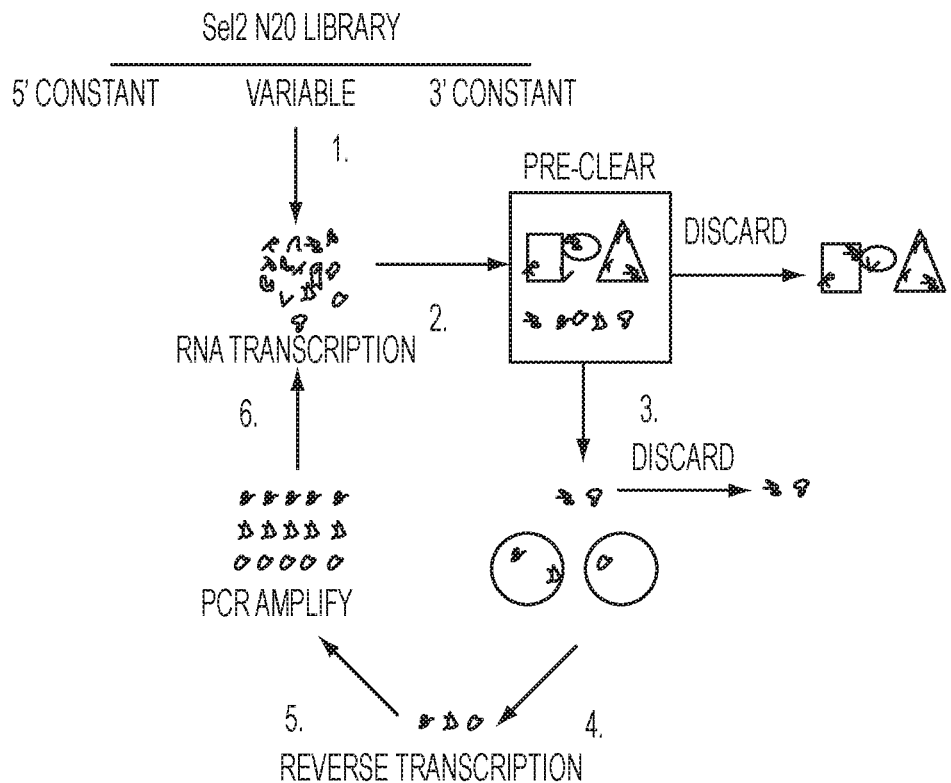
FIG. 5. Schematic of in vitro SELEX technology.

Binding Affinities ($K_D$) of the Different Clones in FIG. 5 for Histones H3, H4, and Human Serum (FIG. 21).

Binding of Individual RNA Aptamers to Histone H3, H4, and Human Albumin (FIGS. 22A-22I).

Binding of aptamers KU1 (A), KU2 (B), KU 3 (C), KU4 (D), KU5 (E), KU6 (F), KU 7 (G), KU 8 (H), KU 9 (I) to Human Albumin (triangles), H3 (light circles), and H4 (dark squares) measured by filter binding assay.

Figure 22C:
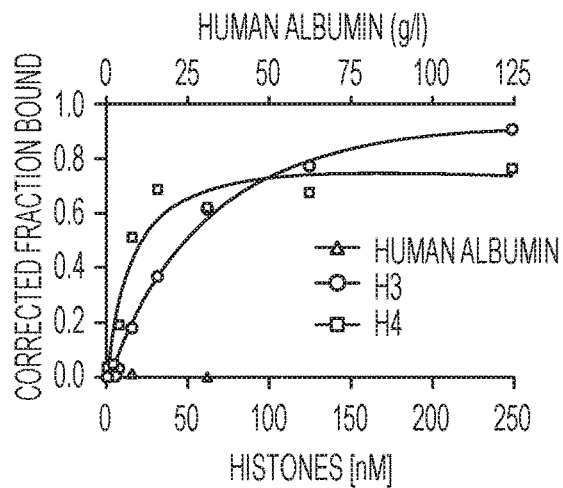
Figure 22D:
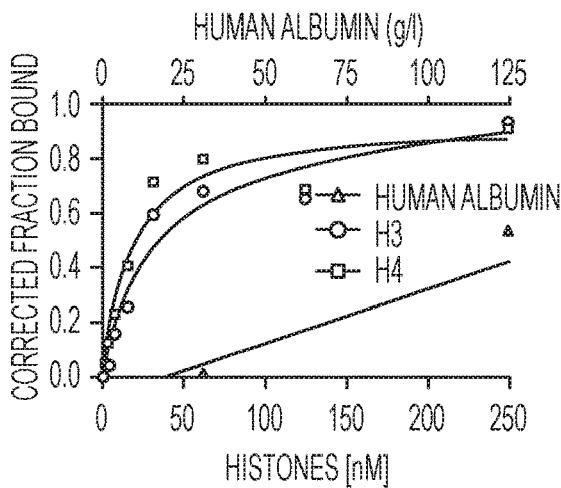
Figure 22E:
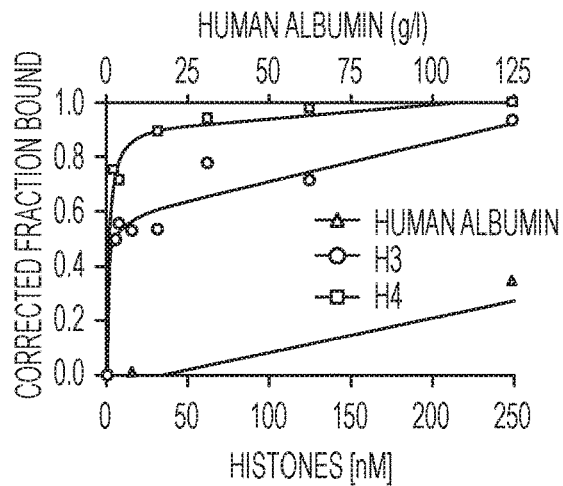
Figure 22F:
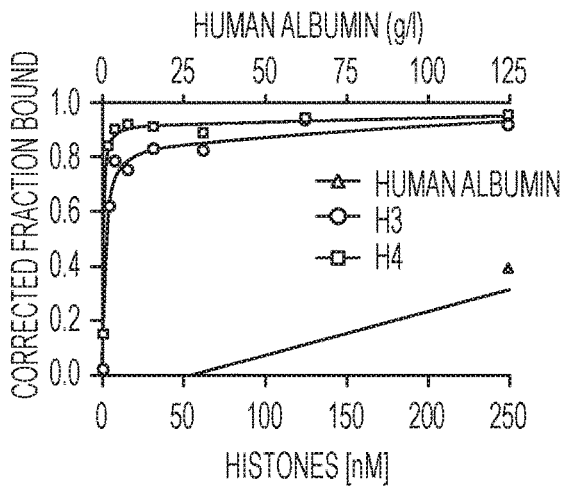
Figure 22G:
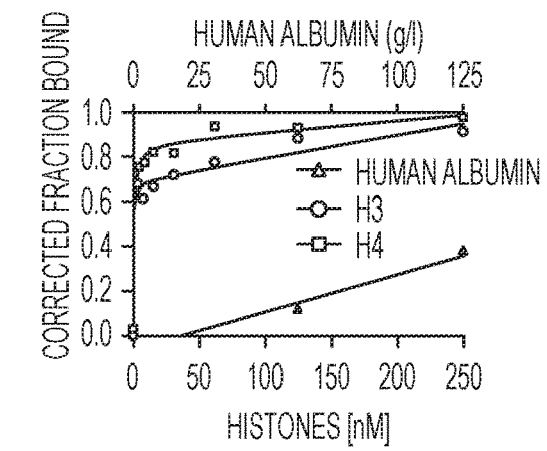
Figure 22H:
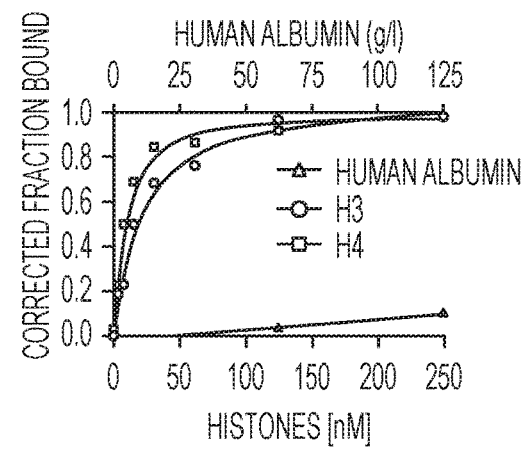
Figures 22I, 23:
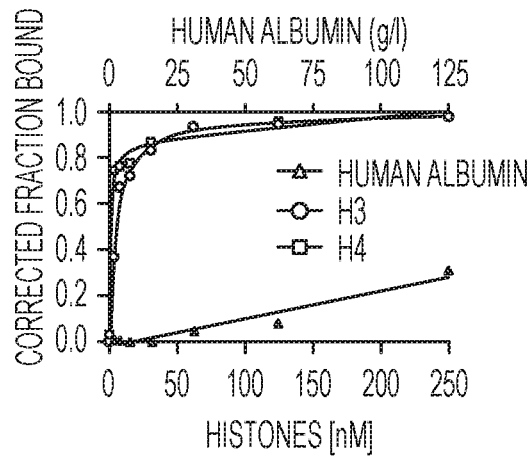

Binding Affinities ($K_D$) of the Different Clones in FIG. 6 for Histones H3, H4, and Human Albumin (FIG. 23).

Figure 24A:
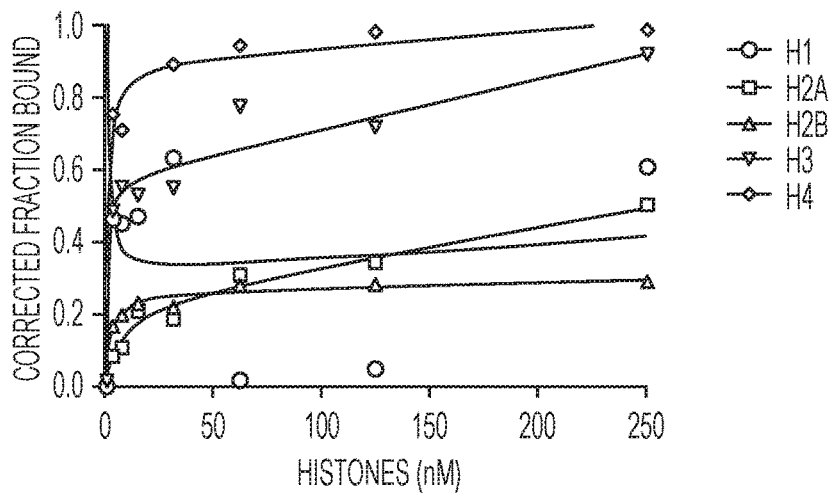
FIGS. 24A-24C. Binding data of individual RNA aptamers to histones H1, H2A, H2B, H3 and H4 proteins.
Figure 24B:
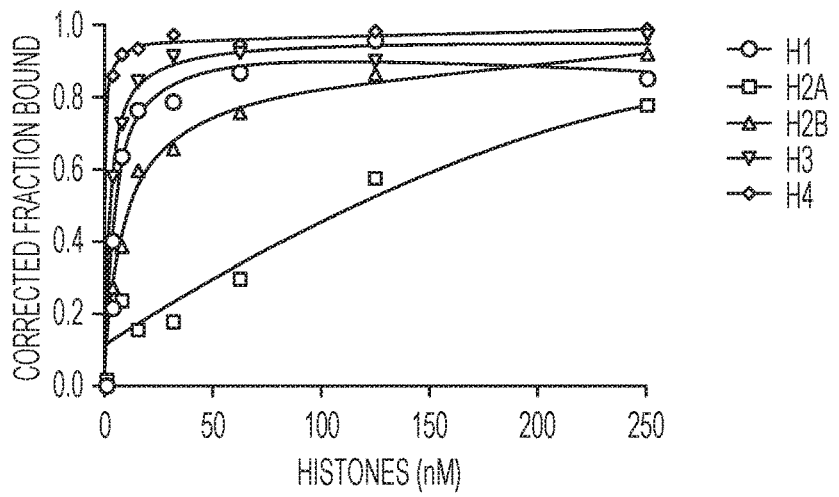
Figure 24C:
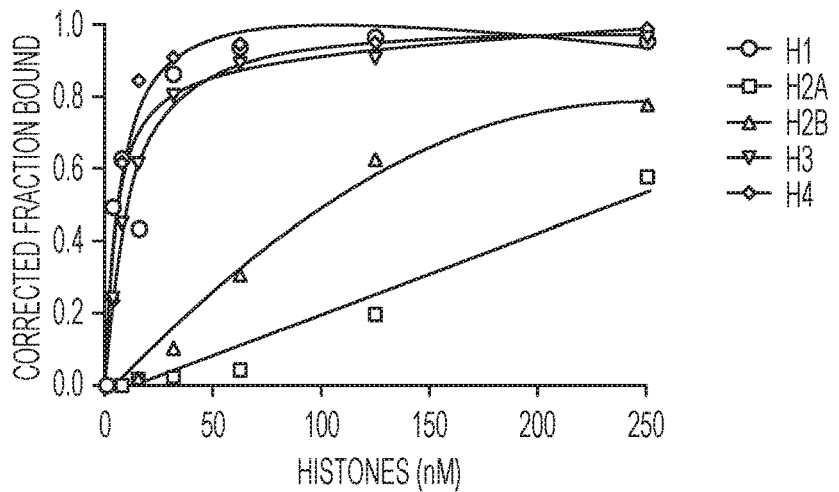

Binding of Individual RNA Aptamers to Histone H1, H2A, H2B, H3, and H4 Proteins (FIGS. 24A-24C).

Binding of aptamer clones (A) KU5, (B) KU7, (C) KU9 to histones H1 (circles), H2A (squares), H2B (upward triangle), H3 (downward triangle), and H4 (diamonds) measured by filter binding assay.

Figures 25, 26:
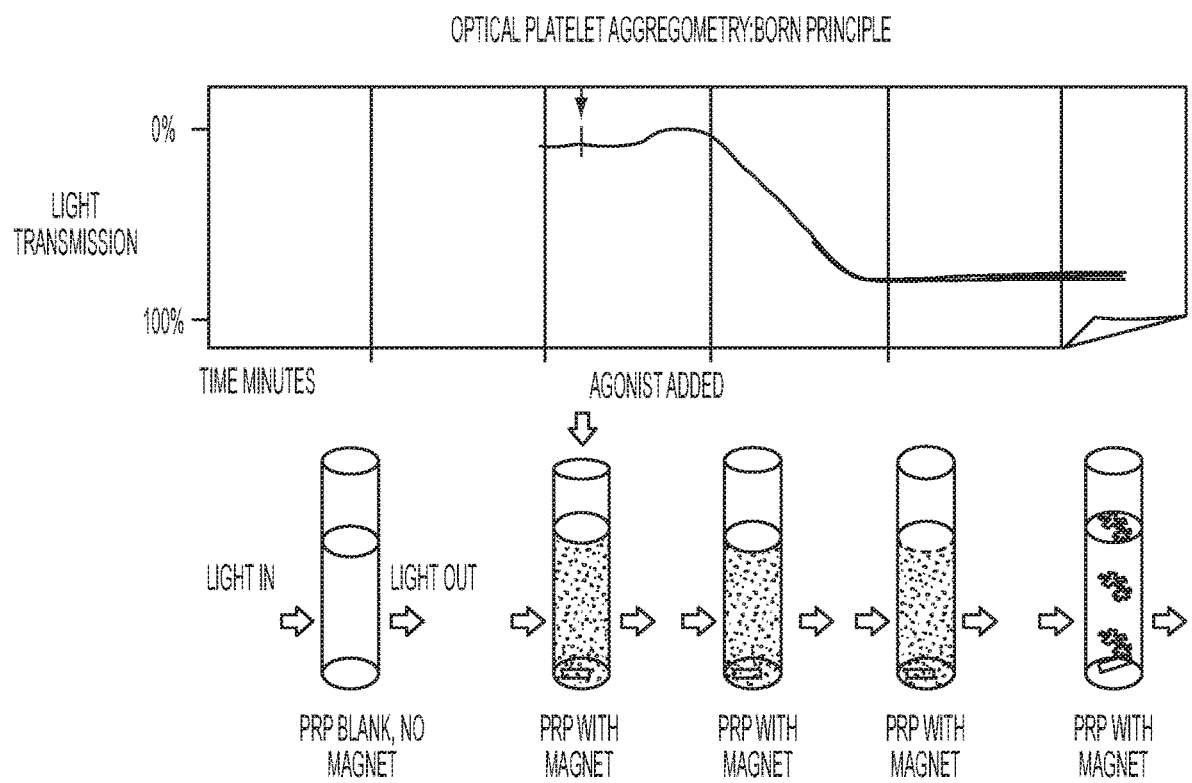
FIG. 25. Table of binding affinities.
FIG. 26. Schematic of platelet aggregometer.
Figure 27A:
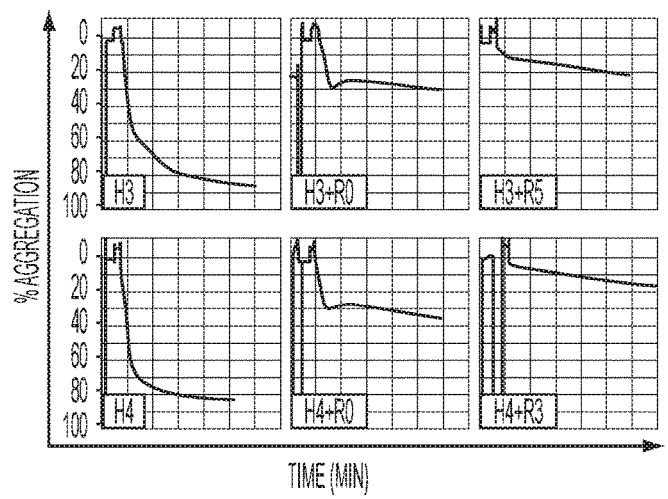
FIGS. 27A-27D. Platelet aggregation data.
Figure 27B:
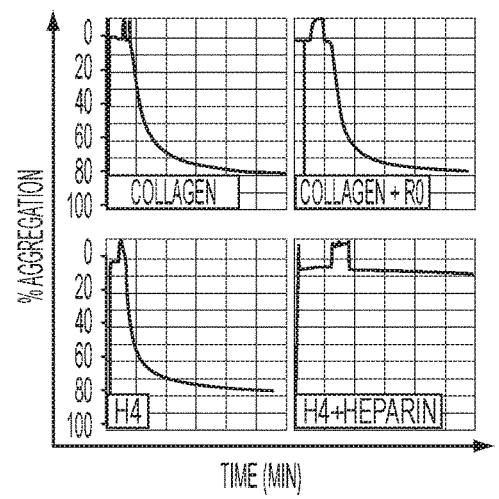
Figure 27C:
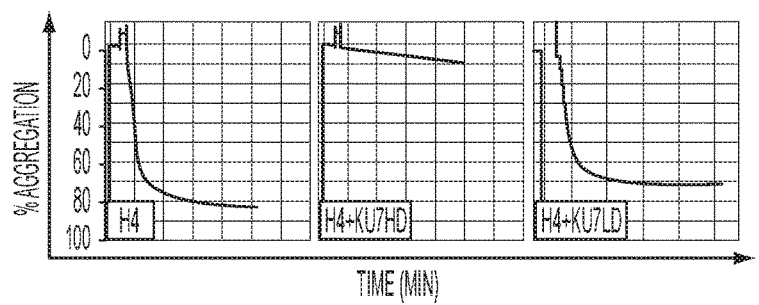
Figure 27D:
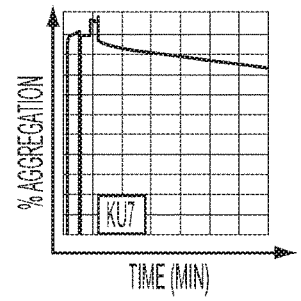

Binding Affinities ($K_D$) of the Different Clones in FIG. 7 for Histones H1, H2A, H2B, H3, and H4 (FIG. 25).

Schematic of Platelet Aggregometer (FIG. 26).

Platelet poor plasma [PPP] is stirred in a cuvette at 37° C. and the cuvette sits between a light course and a photocell. When an agonist is added the platelets aggregate and absorb less light and so the transmission increases and this is detected by the photocell. Schematic adapted from http://practical-haemostasis.com/Platelets/platelet_function_testing_lta.html RNA Aptamers Inhibit Histone-Mediated Platelet Aggregation (FIGS. 27A-27D).

Platelet aggregation was performed with washed human platelets and quantitated using an aggregometer at 2 min intervals. (A) Histones H3 and H4 induce platelet aggregation. Addition of the unselected round 0 aptamer pool (10 nM) reduces platelet aggregation. A more pronounced inhibition of platelet aggregation is observed with selected RNA pools (Rnd5 for H3 and Rnd3 for H4). (B) RNA aptamers have no effect on collagen-mediated platelet aggregation. Heparin (1 U/ml) reverses histone-mediated platelet aggregation. (C) Selected aptamer KU7 high dose (KU7HD, 1000 nM) showed pronounced inhibition of histone H4, while KU7 low dose (100 nM) inhibited only slightly. (D) RNA aptamer KU7 only did not induce platelet aggregation.

Figure 28:
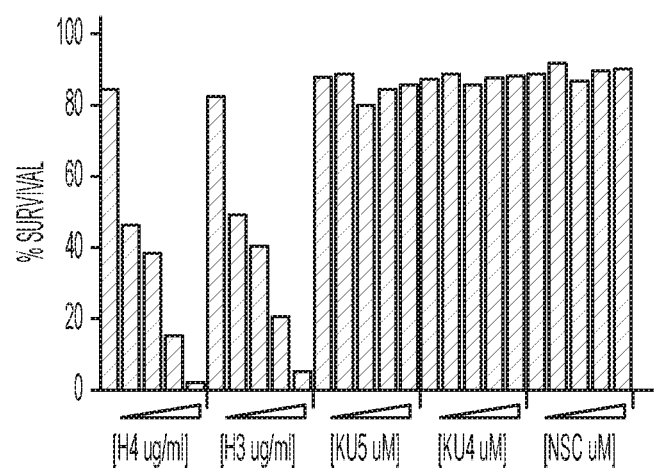
FIG. 28. Cytotoxicity data.

Cytotoxicity of Histones to Endothelial Cells (FIG. 28).

EA.hy926 cells were cultured with human (A) histone H3, (B) histone H4, or (C) aptamers (KU5, KU4, or NSC) for 1 hr at 37° C. Cell damage was measured by flow cytometry for propidium iodide staining. Histone concentration: 0, 12.5, 25, 50, 100 μg/mL and aptamer concentration: 0.0, 12.5, 25, 50, 100 nM. NSC refers to a non-specific control aptamer sequence that does not bind histones.

Figure 29:
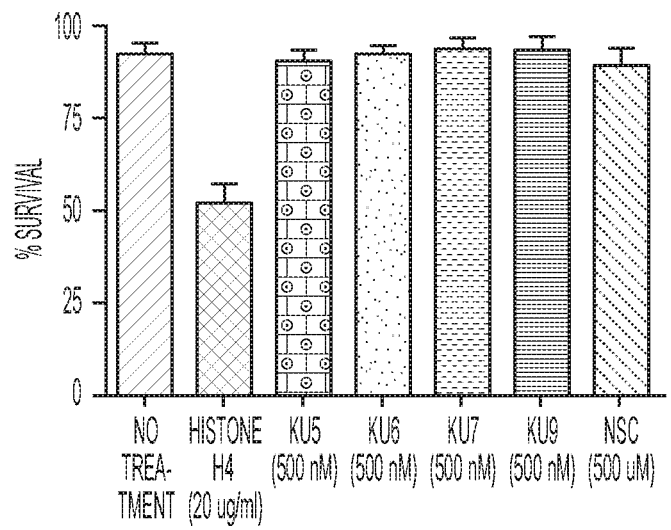
FIG. 29. Cytotoxicity data.

Cytotoxicity Histones to Epithelial Cells (FIG. 29).

Epithelial cells (A549) were incubated With H4 (20 μg/ml) or the aptamers KU5, KU6, KU7, KU9 or control aptamer NSC (all aptamers at 500 uM) concentration for 1 hour. After the hour the cells were treated with propidium iodide and flow cytometry was performed. The percent of all cells that did not stain for P1 are shown.

Figure 30:
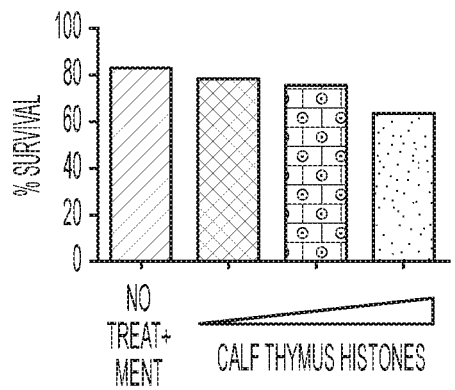
FIG. 30. Cytotoxicity data.

Cytotoxicity of Calf Thymus Histones to Epithelial Cells (FIG. 30).

Epithelial cells (A549) were incubated with calf thymus histones (25, 50, 100 μg/ml) concentration for 1 hour. After the hour the cells were treated with propidium iodide and flow cytometry was performed. The percent of all cells that did not stain for PI are shown.

Figure 31:
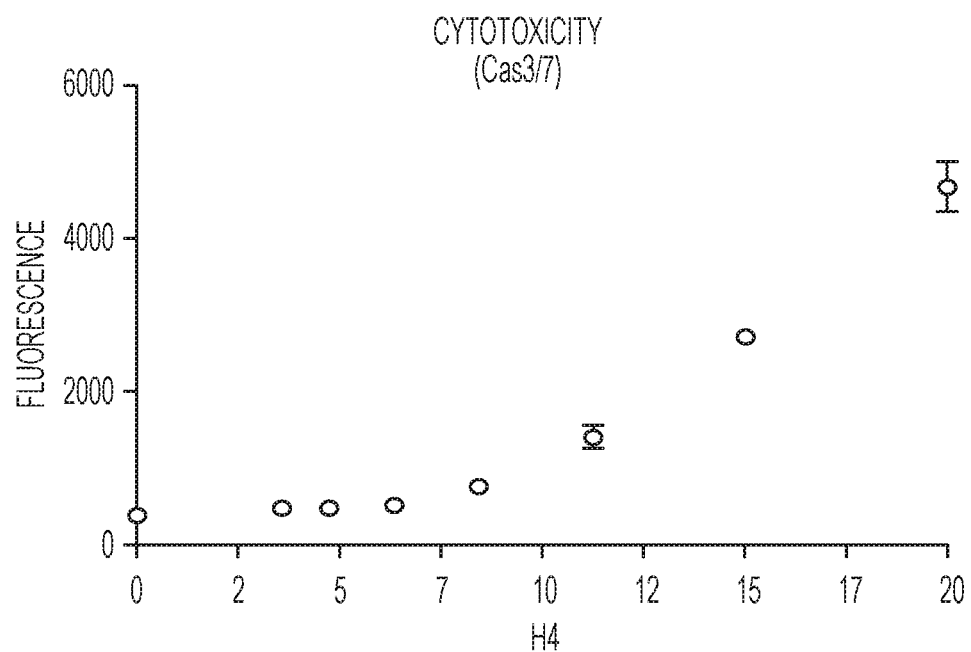
FIG. 31. Cytotoxicity data.

Apoptosis Activation of Histones to Epithelial Cells (FIG. 31).

A549 cells were cultured with human histone H4 for 6 hr at 37° C. Cell apoptosis was measured by florescence using the cellevent Caspase 3/7 kit. Historic concentration: 0, 35.6, 47.5, 63.3, 84.4, 112.5, 150, 200 ug/mL.

Figure 32:
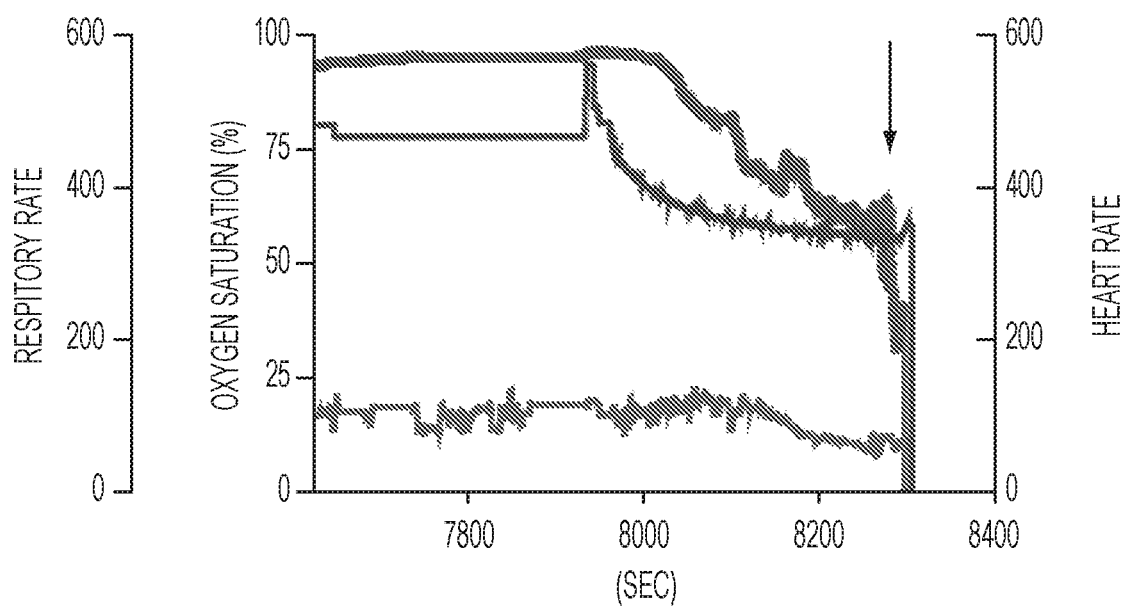
FIG. 32. Mouse data.

Histone Induced Toxicity In Vivo (FIG. 32).

Noninvasive measurement of respiratory rate, heart rate, and oxygen saturation were continuously monitored in a mouse, which was injected with 180 mg/ml of calf thymus histories via tail vein. Arrow indicates time of death. Respiratory rate lowest starting line; % oxygen saturation—highest starting line; heart rate middle starting line.

Summary

As shown in the data above, aptamers were identified that bind to histones H3.2 and H4 using the Systematic Evolution of Ligands by Exponential Enrichment (SELEX) technology (FIG. 5). Following eight rounds of selection (R8), RNA sequences were enriched with overall higher affinity (pM vs. nM range) for the intended histone target compared to the starting, unenriched RNA aptamer library (round 0, R0) (FIG. 12). The progression of the H3.2 and H4 selections was assessed by determining the sequence diversity of the random regions from round to round by high-throughput sequencing (HTS) and identifying enriched sequence and structure families using bioinformatics analysis (FIGS. 7-9). Individual RNA aptamer candidates (9 total) identified from the sequence/bioinformatics analyses were screened to determine binding affinities and specificities (FIGS. 15-24). Binding data are shown for the top nine candidate aptamers (most highly enriched aptamers following 8 rounds of selection) identified from the bioinformatics analysis (FIG. 10). Although the aptamers were selected against H3.2 and H4, binding to histones H1 (FIG. 17-18 and FIG. 23-24), H2A and H2B (FIGS. 23-24) (the equilibrium dissociation constants are reported in the tables) were also determined. The binding data confirm that these aptamers bind with high affinity (KD=pM to low nM range) to histones H3.2 and H4 (FIGS. 23-24). For example, Aptamer KU5 also binds to histones H2A and H2B (affinities in the low nM range) but not H1. Interestingly, aptamer KU7 binds H1 and H2B (KD=low nM range) but not H2A and aptamer KU9 does not bind to histones H2A or H2B but has high affinity for histone H1 (KD=5.3 nM). In addition, binding specificity for the histone proteins was demonstrated by confirming that the RNAs do not bind to proteins in human serum (FIGS. 19-20)

or to human serum albumin (a protein which is highly abundant in serum) (FIGS. 21-22). As an additional measure of specificity, it was confirmed that two control aptamers (NSC and A9g) do not bind to the histone proteins (FIG. 14).

In Vitro Functional Data:

Platelet Aggregation (FIGS. 25-26):

The release of histones from dying cells is associated with microvascular thrombosis. Histone H4 and, to a lesser extent H3.2, have been found to be responsible for directly inducing aggregation of human platelets by driving plasma thrombin generation through the activation of TLR2 and TLR4. It is shown that histones H3.2 and H4 induce pronounced platelet aggregation (plotted as % aggregation), which can be inhibited with addition of heparin (positive control) and the unselected RNA aptamer pool (R0). Importantly, aptamer inhibition of histone-mediated platelet aggregation was more pronounced with selected histone aptamers (data shown for KU7) compared to the unselected RNA pool (R0). As a measure of specificity, the RNA aptamers did not reverse collagen-mediated aggregation.

Aptamer Safety Profile In Vitro (FIGS. 27-31):

Circulating histones cause endothelial cell toxicity, contributing to vascular dysfunction, platelet aggregation and tissue ischemia. It was confirmed that the exposure of cultured epithelial cells with histone H4 (20 ng/ml for 1 hours) results in cell death. In contrast, the candidate histone-selective aptamers (KU5, KU7, KU9) did not induce cell toxicity (1 µM for 1 hour).

Histone-Mediated Toxicity In Vivo (FIG. 32):

Histone administration causes neutrophil migration, endothelial injury and dysfunction, hemorrhage, and thrombosis, which finally result in animal death at doses as low as 50 mg/kg body weight. It was confirmed that injection of histones into the circulation leads to organ failure and subsequent death in a mouse model of multiple organ dysfunction syndrome (MODS). In this experiment, a C57/BL6 mouse was injected with 180 µg/mL of histone from calf thymus while noninvasively monitoring the animal's respiratory rate, heart rate and oxygen saturation. Following intravenous histone injection, oxygen saturation gradually declined over several minutes and the mouse died. These data confirm the acute lung injury caused by circulating histones and identify a model for proposed studies to evaluate the ability of RNA aptamers to protect from histone-mediated lung injury in vivo.

Lengthy table referenced here

US10633410-20200428-T00001

Please refer to the end of the specification for access instructions.

Although the foregoing specification and examples fully disclose and enable the present invention, they are not intended to limit the scope of the invention, which is defined by the claims appended hereto.

All publications, patents and patent applications are incorporated herein by reference. While in the foregoing specification this invention has been described in relation to certain embodiments thereof, and many details have been set forth for purposes of illustration, it will be apparent to those skilled in the art that the invention is susceptible to additional embodiments and that certain of the details described herein may be varied considerably without departing from the basic principles of the invention.

The use of the terms "a" and "an" and "the" and similar referents in the context of describing the invention are to be construed to cover both the singular and the plural, unless otherwise indicated herein or clearly contradicted by context. The terms "comprising," "having," "including" and "containing" are to be construed as open-ended terms (i.e., meaning "including, but not limited to") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

LENGTHY TABLES

The patent contains a lengthy table section. A copy of the table is available in electronic form from the USPTO web site (http://seqdata.uspto.gov/?pageRequest=docDetail&DocID=US10633410B2). An electronic copy of the table will also be available from the USPTO upon request and payment of the fee set forth in 37 CFR 1.19(b)(3).

SEQUENCE LISTING (15192 sequences)

SEQ ID NO: 1 - DNA, 20 bp, Artificial Sequence
  Description of Artificial Sequence: Synthetic oligonucleotide
tttgaagggtgatgggtccg

SEQ ID NO: 2 - DNA, 20 bp, Artificial Sequence
  Description of Artificial Sequence: Synthetic oligonucleotide
ttgggtgtagggtggtaccg

SEQ ID NO: 3 - DNA, 20 bp, Artificial Sequence
  Description of Artificial Sequence: Synthetic oligonucleotide
attggtgaagggaggtactg

SEQ ID NO: 4 - DNA, 20 bp, Artificial Sequence
  Description of Artificial Sequence: Synthetic oligonucleotide
gcctttcgttctgccctccc

SEQ ID NO: 5 - DNA, 20 bp, Artificial Sequence
  Description of Artificial Sequence: Synthetic oligonucleotide
gcctttcgttctgacctccc

SEQ ID NO: 6 - DNA, 20 bp, Artificial Sequence
  Description of Artificial Sequence: Synthetic oligonucleotide
attggtgaagggaggtaccg

SEQ ID NO: 7 - DNA, 20 bp, Artificial Sequence
  Description of Artificial Sequence: Synthetic oligonucleotide
cagaggagaagggaggttgc

SEQ ID NO: 8 - DNA, 20 bp, Artificial Sequence
  Description of Artificial Sequence: Synthetic oligonucleotide
tgtaggaggaggaggtaccg

SEQ ID NO: 9 - DNA, 20 bp, Artificial Sequence
  Description of Artificial Sequence: Synthetic oligonucleotide
tcctgtcgtctgttcgtccc

SEQ ID NO: 10 - DNA, 20 bp, Artificial Sequence
  Description of Artificial Sequence: Synthetic oligonucleotide
tttgaagggtggtgggtccg

SEQ ID NO: 11 - DNA, 20 bp, Artificial Sequence
  Description of Artificial Sequence: Synthetic oligonucleotide
tattggaggtgtagggaccg

SEQ ID NO: 12 - DNA, 20 bp, Artificial Sequence
  Description of Artificial Sequence: Synthetic oligonucleotide
tttggggttttcccgtgccc

SEQ ID NO: 13 - DNA, 20 bp, Artificial Sequence
  Description of Artificial Sequence: Synthetic oligonucleotide
atagggagaagggtgaaccg

SEQ ID NO: 14 - DNA, 20 bp, Artificial Sequence
  Description of Artificial Sequence: Synthetic oligonucleotide
ttgggtgtagggtgttaccg

SEQ ID NO: 15 - DNA, 20 bp, Artificial Sequence
  Description of Artificial Sequence: Synthetic oligonucleotide
ttgggtgtagggtggtactg

SEQ ID NO: 16 - DNA, 21 bp, Artificial Sequence
  Description of Artificial Sequence: Synthetic oligonucleotide
gtcctgtcgtctgttcgtccc

SEQ ID NO: 17 - DNA, 20 bp, Artificial Sequence
  Description of Artificial Sequence: Synthetic oligonucleotide
tttgaagggcgatgggtccg

SEQ ID NO: 18 - DNA, 20 bp, Artificial Sequence
  Description of Artificial Sequence: Synthetic oligonucleotide
tttgaagggagatgggtccg

SEQ ID NO: 19 - DNA, 20 bp, Artificial Sequence
  Description of Artificial Sequence: Synthetic oligonucleotide
tttgaagggggatgggtccg

SEQ ID NO: 20 - DNA, 20 bp, Artificial Sequence
  Description of Artificial Sequence: Synthetic oligonucleotide
gtcttctggcttatcgtccc

SEQ ID NO: 21 - DNA, 20 bp, Artificial Sequence
  Description of Artificial Sequence: Synthetic oligonucleotide
tgactcgtctgtttcgtccc

SEQ ID NO: 22 - DNA, 20 bp, Artificial Sequence
  Description of Artificial Sequence: Synthetic oligonucleotide
tccttgtcgtcttgcgtccc

SEQ ID NO: 23 - DNA, 20 bp, Artificial Sequence
  Description of Artificial Sequence: Synthetic oligonucleotide
tttgaagggtgatgggtccc

SEQ ID NO: 24 - DNA, 20 bp, Artificial Sequence
  Description of Artificial Sequence: Synthetic oligonucleotide
ttcgaagggtgatgggtccg

SEQ ID NO: 25 - DNA, 20 bp, Artificial Sequence
  Description of Artificial Sequence: Synthetic oligonucleotide
tgtagggaggtagttatcgt

SEQ ID NO: 26 - DNA, 20 bp, Artificial Sequence
  Description of Artificial Sequence: Synthetic oligonucleotide
gttgaagggtgatgggtccg

SEQ ID NO: 27 - DNA, 19 bp, Artificial Sequence
  Description of Artificial Sequence: Synthetic oligonucleotide
ttgaagggtgatgggtccg

SEQ ID NO: 28 - DNA, 20 bp, Artificial Sequence
  Description of Artificial Sequence: Synthetic oligonucleotide
cttgtcgtcttgttcgtccc

SEQ ID NO: 29 - DNA, 20 bp, Artificial Sequence
  Description of Artificial Sequence: Synthetic oligonucleotide
ttgggtgtagggtggtgccg

SEQ ID NO: 30 - DNA, 20 bp, Artificial Sequence
  Description of Artificial Sequence: Synthetic oligonucleotide
cttgaagggtgatgggtccg

SEQ ID NO: 31 - DNA, 20 bp, Artificial Sequence
  Description of Artificial Sequence: Synthetic oligonucleotide
cgtttcctctggttcgtccc

SEQ ID NO: 32 - DNA, 20 bp, Artificial Sequence
  Description of Artificial Sequence: Synthetic oligonucleotide
tttgaggggtgatgggtccg

SEQ ID NO: 33 - DNA, 20 bp, Artificial Sequence
  Description of Artificial Sequence: Synthetic oligonucleotide
tctgaagggtgatgggtccg

SEQ ID NO: 34 - DNA, 20 bp, Artificial Sequence
  Description of Artificial Sequence: Synthetic oligonucleotide
tgtcgtagtctatccgcccg

SEQ ID NO: 35 - DNA, 20 bp, Artificial Sequence
  Description of Artificial Sequence: Synthetic oligonucleotide
tttgaagggtaatgggtccg

SEQ ID NO: 36 - DNA, 20 bp, Artificial Sequence
  Description of Artificial Sequence: Synthetic oligonucleotide
tttgaagggtgatgggaccg

SEQ ID NO: 37 - DNA, 20 bp, Artificial Sequence
  Description of Artificial Sequence: Synthetic oligonucleotide
tttgaagggtgatgggtctg

SEQ ID NO: 38 - DNA, 20 bp, Artificial Sequence
  Description of Artificial Sequence: Synthetic oligonucleotide
tttgaagggtgatgggcccg

SEQ ID NO: 39 - DNA, 20 bp, Artificial Sequence
  Description of Artificial Sequence: Synthetic oligonucleotide
ttgggtgtagggaggtaccg

SEQ ID NO: 40 - DNA, 20 bp, Artificial Sequence
  Description of Artificial Sequence: Synthetic oligonucleotide
attggtgaagggaggtgctg

SEQ ID NO: 41 - DNA, 20 bp, Artificial Sequence
  Description of Artificial Sequence: Synthetic oligonucleotide
tttgaaggatgatgggtccg

SEQ ID NO: 42 - DNA, 20 bp, Artificial Sequence
  Description of Artificial Sequence: Synthetic oligonucleotide
tttgaagagtgatgggtccg

SEQ ID NO: 43 - DNA, 20 bp, Artificial Sequence
  Description of Artificial Sequence: Synthetic oligonucleotide
tttgaagggtgataggtccg

SEQ ID NO: 44 - DNA, 20 bp, Artificial Sequence
  Description of Artificial Sequence: Synthetic oligonucleotide
tcttgtcgtctgttcgtccc

SEQ ID NO: 45 - DNA, 19 bp, Artificial Sequence
  Description of Artificial Sequence: Synthetic oligonucleotide
tcctgtcgtctgttcgtcc

SEQ ID NO: 46 - DNA, 20 bp, Artificial Sequence
  Description of Artificial Sequence: Synthetic oligonucleotide
tttgaaaggtgatgggtccg

SEQ ID NO: 47 - DNA, 20 bp, Artificial Sequence
  Description of Artificial Sequence: Synthetic oligonucleotide
ttgggtgtagggcggtaccg

SEQ ID NO: 48 - DNA, 20 bp, Artificial Sequence
  Description of Artificial Sequence: Synthetic oligonucleotide
tttgaagggtgatggatccg

SEQ ID NO: 49 - DNA, 21 bp, Artificial Sequence
  Description of Artificial Sequence: Synthetic oligonucleotide
ttttgaagggtgatgggtccg

SEQ ID NO: 50 - DNA, 20 bp, Artificial Sequence
  Description of Artificial Sequence: Synthetic oligonucleotide
tttgaagggtgacgggtccg

SEQ ID NO: 51 - DNA, 20 bp, Artificial Sequence
  Description of Artificial Sequence: Synthetic oligonucleotide
tcctgtcgtctttgcgtccc

SEQ ID NO: 52 - DNA, 20 bp, Artificial Sequence
  Description of Artificial Sequence: Synthetic oligonucleotide
attggtgtagggtggtaccg

SEQ ID NO: 53 - DNA, 19 bp, Artificial Sequence
  Description of Artificial Sequence: Synthetic oligonucleotide
ctattggtgaagggtggtg

SEQ ID NO: 54 - DNA, 20 bp, Artificial Sequence
  Description of Artificial Sequence: Synthetic oligonucleotide
acgtggtgtaggggggtgtc

SEQ ID NO: 55 - DNA, 20 bp, Artificial Sequence
  Description of Artificial Sequence: Synthetic oligonucleotide
tttgaagggtgttgggtccg

SEQ ID NO: 56 - DNA, 19 bp, Artificial Sequence
  Description of Artificial Sequence: Synthetic oligonucleotide
tttgaagggtgatggtccg

SEQ ID NO: 57 - DNA, 20 bp, Artificial Sequence
  Description of Artificial Sequence: Synthetic oligonucleotide
tttgaatggtgatgggtccg

SEQ ID NO: 58 - DNA, 20 bp, Artificial Sequence
  Description of Artificial Sequence: Synthetic oligonucleotide
gttggtgaagggaggtactg

SEQ ID NO: 59 - DNA, 20 bp, Artificial Sequence
  Description of Artificial Sequence: Synthetic oligonucleotide
tttgaagggtgatgtgtccg

SEQ ID NO: 60 - DNA, 20 bp, Artificial Sequence
  Description of Artificial Sequence: Synthetic oligonucleotide
attacgagcttgttgcctcg

SEQ ID NO: 61 - DNA, 20 bp, Artificial Sequence
  Description of Artificial Sequence: Synthetic oligonucleotide
tttggagggtgatgggtccg

SEQ ID NO: 62 - DNA, 20 bp, Artificial Sequence
  Description of Artificial Sequence: Synthetic oligonucleotide
tttgaagggtgattggtccg

SEQ ID NO: 63 - DNA, 20 bp, Artificial Sequence
  Description of Artificial Sequence: Synthetic oligonucleotide
ttgggtgtaggggggtaccg

SEQ ID NO: 64 - DNA, 20 bp, Artificial Sequence
  Description of Artificial Sequence: Synthetic oligonucleotide
tttgaagggtgatgagtccg

SEQ ID NO: 65 - DNA, 20 bp, Artificial Sequence
  Description of Artificial Sequence: Synthetic oligonucleotide
tttgaagggtgatgggttcg

SEQ ID NO: 66 - DNA, 20 bp, Artificial Sequence
  Description of Artificial Sequence: Synthetic oligonucleotide
tttgaagggtgatgggtcca

SEQ ID NO: 67 - DNA, 20 bp, Artificial Sequence
  Description of Artificial Sequence: Synthetic oligonucleotide
cgattcctctggttcgtccc

SEQ ID NO: 68 - DNA, 20 bp, Artificial Sequence
  Description of Artificial Sequence: Synthetic oligonucleotide
tttggtgaagggaggtactg

SEQ ID NO: 69 - DNA, 20 bp, Artificial Sequence
  Description of Artificial Sequence: Synthetic oligonucleotide
cgactcgatctgttcgtccc

SEQ ID NO: 70 - DNA, 19 bp, Artificial Sequence
  Description of Artificial Sequence: Synthetic oligonucleotide
attggtgaagggaggttgc

SEQ ID NO: 71 - DNA, 20 bp, Artificial Sequence
  Description of Artificial Sequence: Synthetic oligonucleotide
tttgaagggtgatggctccg

SEQ ID NO: 72 - DNA, 20 bp, Artificial Sequence
  Description of Artificial Sequence: Synthetic oligonucleotide
tcctggcttgtcgttgtccc

SEQ ID NO: 73 - DNA, 19 bp, Artificial Sequence
  Description of Artificial Sequence: Synthetic oligonucleotide
tttgaagggtgatgggtcg

SEQ ID NO: 74 - DNA, 19 bp, Artificial Sequence
  Description of Artificial Sequence: Synthetic oligonucleotide
gcctttcgttctgcctccc

SEQ ID NO: 75 - DNA, 20 bp, Artificial Sequence
  Description of Artificial Sequence: Synthetic oligonucleotide
ttctggcttgtcgttgtccc

SEQ ID NO: 76 - DNA, 20 bp, Artificial Sequence
  Description of Artificial Sequence: Synthetic oligonucleotide
attggcgaagggaggtactg

SEQ ID NO: 77 - DNA, 20 bp, Artificial Sequence
  Description of Artificial Sequence: Synthetic oligonucleotide
tttgaagggttatgggtccg

SEQ ID NO: 78 - DNA, 20 bp, Artificial Sequence
  Description of Artificial Sequence: Synthetic oligonucleotide
tttgaagggtgctgggtccg

SEQ ID NO: 79 - DNA, 20 bp, Artificial Sequence
  Description of Artificial Sequence: Synthetic oligonucleotide
tttgaagtgtgatgggtccg

SEQ ID NO: 80 - DNA, 20 bp, Artificial Sequence
  Description of Artificial Sequence: Synthetic oligonucleotide
ttgggagtagggtggtaccg

SEQ ID NO: 81 - DNA, 20 bp, Artificial Sequence
  Description of Artificial Sequence: Synthetic oligonucleotide
tttgatgggtgatgggtccg

SEQ ID NO: 82 - DNA, 20 bp, Artificial Sequence
  Description of Artificial Sequence: Synthetic oligonucleotide
ttgggcgtagggtggtaccg

SEQ ID NO: 83 - DNA, 20 bp, Artificial Sequence
  Description of Artificial Sequence: Synthetic oligonucleotide
tttgaagggtgatggttccg

SEQ ID NO: 84 - DNA, 20 bp, Artificial Sequence
  Description of Artificial Sequence: Synthetic oligonucleotide
attggtgaaggggggtactg

SEQ ID NO: 85 - DNA, 20 bp, Artificial Sequence
  Description of Artificial Sequence: Synthetic oligonucleotide
gcctttcgttctgcccttcc

SEQ ID NO: 86 - DNA, 20 bp, Artificial Sequence
  Description of Artificial Sequence: Synthetic oligonucleotide
ttgggtgtagggaggtactg

SEQ ID NO: 87 - DNA, 20 bp, Artificial Sequence
  Description of Artificial Sequence: Synthetic oligonucleotide
taaaggagtggggaggtccg

SEQ ID NO: 88 - DNA, 20 bp, Artificial Sequence
  Description of Artificial Sequence: Synthetic oligonucleotide
attggtgaagggagggactg

SEQ ID NO: 89 - DNA, 20 bp, Artificial Sequence
  Description of Artificial Sequence: Synthetic oligonucleotide
tttggggttttcccgtgccg

SEQ ID NO: 90 - DNA, 20 bp, Artificial Sequence
  Description of Artificial Sequence: Synthetic oligonucleotide
ttagggtgtagggtggtgcg

SEQ ID NO: 91 - DNA, 20 bp, Artificial Sequence
  Description of Artificial Sequence: Synthetic oligonucleotide
ttgggtgtagggtggttccg

SEQ ID NO: 92 - DNA, 20 bp, Artificial Sequence
  Description of Artificial Sequence: Synthetic oligonucleotide
gcctttcgttctgctctccc

SEQ ID NO: 93 - DNA, 20 bp, Artificial Sequence
  Description of Artificial Sequence: Synthetic oligonucleotide
attggtggagggaggtactg

SEQ ID NO: 94 - DNA, 20 bp, Artificial Sequence
  Description of Artificial Sequence: Synthetic oligonucleotide
tttgaagggtgatgggtcgg

SEQ ID NO: 95 - DNA, 20 bp, Artificial Sequence
  Description of Artificial Sequence: Synthetic oligonucleotide
ctaagaggaggtgatgggag

SEQ ID NO: 96 - DNA, 20 bp, Artificial Sequence
  Description of Artificial Sequence: Synthetic oligonucleotide
tttgtagggtgatgggtccg

SEQ ID NO: 97 - DNA, 20 bp, Artificial Sequence
  Description of Artificial Sequence: Synthetic oligonucleotide
atttttggagaagggaggtg

SEQ ID NO: 98 - DNA, 20 bp, Artificial Sequence
  Description of Artificial Sequence: Synthetic oligonucleotide
tttaaagggtgatgggtccg

SEQ ID NO: 99 - DNA, 20 bp, Artificial Sequence
  Description of Artificial Sequence: Synthetic oligonucleotide
tatacggcggtgtggggata

SEQ ID NO: 100 - DNA, 20 bp, Artificial Sequence
  Description of Artificial Sequence: Synthetic oligonucleotide
tttgaagggtgatggggccg

SEQ ID NO: 101 - DNA, 20 bp, Artificial Sequence
  Description of Artificial Sequence: Synthetic oligonucleotide
attggtgaagggaggcactg

SEQ ID NO: 102 - DNA, 20 bp, Artificial Sequence
  Description of Artificial Sequence: Synthetic oligonucleotide
tgtaggaggaggaggtactg

SEQ ID NO: 103 - DNA, 20 bp, Artificial Sequence
  Description of Artificial Sequence: Synthetic oligonucleotide
atgtatgttgggagccacgc

SEQ ID NO: 104 - DNA, 19 bp, Artificial Sequence
  Description of Artificial Sequence: Synthetic oligonucleotide
gcctttcgttctgccctcc

SEQ ID NO: 105 - DNA, 20 bp, Artificial Sequence
  Description of Artificial Sequence: Synthetic oligonucleotide
tatacggtggtgtggggata

SEQ ID NO: 106 - DNA, 20 bp, Artificial Sequence
  Description of Artificial Sequence: Synthetic oligonucleotide
ttacggaggtgaggggcaac

SEQ ID NO: 107 - DNA, 20 bp, Artificial Sequence
  Description of Artificial Sequence: Synthetic oligonucleotide
ttttaagggtgatgggtccg

SEQ ID NO: 108 - DNA, 20 bp, Artificial Sequence
  Description of Artificial Sequence: Synthetic oligonucleotide
attggtgaagggtggtaccg

SEQ ID NO: 109 - DNA, 20 bp, Artificial Sequence
  Description of Artificial Sequence: Synthetic oligonucleotide
tttgaaggttgatgggtccg

SEQ ID NO: 110 - DNA, 20 bp, Artificial Sequence
  Description of Artificial Sequence: Synthetic oligonucleotide
ttgggggtagggtggtaccg

SEQ ID NO: 111 - DNA, 20 bp, Artificial Sequence
  Description of Artificial Sequence: Synthetic oligonucleotide
ctgggtgtagggtggtaccg

SEQ ID NO: 112 - DNA, 20 bp, Artificial Sequence
  Description of Artificial Sequence: Synthetic oligonucleotide
gcctttcgttctaccctccc

SEQ ID NO: 113 - DNA, 20 bp, Artificial Sequence
  Description of Artificial Sequence: Synthetic oligonucleotide
attgaagggtgatgggtccg

SEQ ID NO: 114 - DNA, 21 bp, Artificial Sequence
  Description of Artificial Sequence: Synthetic oligonucleotide
tttgaagggtgatgggtaccg

SEQ ID NO: 115 - DNA, 20 bp, Artificial Sequence
  Description of Artificial Sequence: Synthetic oligonucleotide
tttgaagggtgatgggtcag

SEQ ID NO: 116 - DNA, 19 bp, Artificial Sequence
  Description of Artificial Sequence: Synthetic oligonucleotide
atggtgaagggaggtactg

SEQ ID NO: 117 - DNA, 20 bp, Artificial Sequence
  Description of Artificial Sequence: Synthetic oligonucleotide
gcctttcgttctgccctctc

SEQ ID NO: 118 - DNA, 20 bp, Artificial Sequence
  Description of Artificial Sequence: Synthetic oligonucleotide
tgagtcgttcccttcgtccc

SEQ ID NO: 119 - DNA, 20 bp, Artificial Sequence
  Description of Artificial Sequence: Synthetic oligonucleotide
tttgaagggtgaagggtccg

SEQ ID NO: 120 - DNA, 20 bp, Artificial Sequence
  Description of Artificial Sequence: Synthetic oligonucleotide
gactagcgatctgttacgca

SEQ ID NO: 121 - DNA, 20 bp, Artificial Sequence
  Description of Artificial Sequence: Synthetic oligonucleotide
tttgcagggtgatgggtccg

SEQ ID NO: 122 - DNA, 20 bp, Artificial Sequence
  Description of Artificial Sequence: Synthetic oligonucleotide
tttgaagggtgatgggtacg

SEQ ID NO: 123 - DNA, 20 bp, Artificial Sequence
  Description of Artificial Sequence: Synthetic oligonucleotide
tcctgtcgtctgttcttccc

SEQ ID NO: 124 - DNA, 20 bp, Artificial Sequence
  Description of Artificial Sequence: Synthetic oligonucleotide
attggaggtggtgggttccg

SEQ ID NO: 125 - DNA, 20 bp, Artificial Sequence
  Description of Artificial Sequence: Synthetic oligonucleotide
atcggtgaagggaggtactg

SEQ ID NO: 126 - DNA, 19 bp, Artificial Sequence
  Description of Artificial Sequence: Synthetic oligonucleotide
tctgtgtgggatgtggccc

SEQ ID NO: 127 - DNA, 20 bp, Artificial Sequence
  Description of Artificial Sequence: Synthetic oligonucleotide
tttgaagggtgatgggtcct

SEQ ID NO: 128 - DNA, 18 bp, Artificial Sequence
  Description of Artificial Sequence: Synthetic oligonucleotide
gcctttcgttgccctccc

SEQ ID NO: 129 - DNA, 19 bp, Artificial Sequence
  Description of Artificial Sequence: Synthetic oligonucleotide
tttgaaggtgatgggtccg

SEQ ID NO: 130 - DNA, 20 bp, Artificial Sequence
  Description of Artificial Sequence: Synthetic oligonucleotide
ttgggtgtagggtggcaccg

SEQ ID NO: 131 - DNA, 20 bp, Artificial Sequence
  Description of Artificial Sequence: Synthetic oligonucleotide
gtcctgtcgtcttacgtccc

SEQ ID NO: 132 - DNA, 20 bp, Artificial Sequence
  Description of Artificial Sequence: Synthetic oligonucleotide
attggtgaggggaggtactg

SEQ ID NO: 133 - DNA, 20 bp, Artificial Sequence
  Description of Artificial Sequence: Synthetic oligonucleotide
gccttcgtttggttcgtccc

SEQ ID NO: 134 - DNA, 20 bp, Artificial Sequence
  Description of Artificial Sequence: Synthetic oligonucleotide
attggtgaagggagttactg

SEQ ID NO: 135 - DNA, 20 bp, Artificial Sequence
  Description of Artificial Sequence: Synthetic oligonucleotide
ttgggtgtggggtggtaccg

SEQ ID NO: 136 - DNA, 20 bp, Artificial Sequence
  Description of Artificial Sequence: Synthetic oligonucleotide
attggtgaagggaggaactg

SEQ ID NO: 137 - DNA, 20 bp, Artificial Sequence
  Description of Artificial Sequence: Synthetic oligonucleotide
tttggtgtagggtggtaccg

SEQ ID NO: 138 - DNA, 20 bp, Artificial Sequence
  Description of Artificial Sequence: Synthetic oligonucleotide
ttgggtgtagggtgggaccg

SEQ ID NO: 139 - DNA, 20 bp, Artificial Sequence
  Description of Artificial Sequence: Synthetic oligonucleotide
ctgtctaccttctactgccg

SEQ ID NO: 140 - DNA, 20 bp, Artificial Sequence
  Description of Artificial Sequence: Synthetic oligonucleotide
tttgacgggtgatgggtccg

SEQ ID NO: 141 - DNA, 20 bp, Artificial Sequence
  Description of Artificial Sequence: Synthetic oligonucleotide
gcctttcgttctgcctcccc

SEQ ID NO: 142 - DNA, 20 bp, Artificial Sequence
  Description of Artificial Sequence: Synthetic oligonucleotide
attggtgaagggtggtactg

SEQ ID NO: 143 - DNA, 19 bp, Artificial Sequence
  Description of Artificial Sequence: Synthetic oligonucleotide
gccttcgttctgacctccc

SEQ ID NO: 144 - DNA, 20 bp, Artificial Sequence
  Description of Artificial Sequence: Synthetic oligonucleotide
ttgggtgcagggtggtaccg

SEQ ID NO: 145 - DNA, 20 bp, Artificial Sequence
  Description of Artificial Sequence: Synthetic oligonucleotide
actggtgaagggaggtactg

SEQ ID NO: 146 - DNA, 20 bp, Artificial Sequence
  Description of Artificial Sequence: Synthetic oligonucleotide
tgcgtttcgtctcgcgtccc

SEQ ID NO: 147 - DNA, 20 bp, Artificial Sequence
  Description of Artificial Sequence: Synthetic oligonucleotide
tctgtacagtctcccatgtg

SEQ ID NO: 148 - DNA, 20 bp, Artificial Sequence
  Description of Artificial Sequence: Synthetic oligonucleotide
gcttttcgttctgccctccc

SEQ ID NO: 149 - DNA, 20 bp, Artificial Sequence
  Description of Artificial Sequence: Synthetic oligonucleotide
tttgaagggtgatgggtgcg

SEQ ID NO: 150 - DNA, 20 bp, Artificial Sequence
  Description of Artificial Sequence: Synthetic oligonucleotide
gcctttcgttctgccttccc

SEQ ID NO: 151 - DNA, 20 bp, Artificial Sequence
  Description of Artificial Sequence: Synthetic oligonucleotide
gcctttcgttcttccctccc

SEQ ID NO: 152 - DNA, 20 bp, Artificial Sequence
  Description of Artificial Sequence: Synthetic oligonucleotide
tcctttcgttctgccctccc

SEQ ID NO: 153 - DNA, 20 bp, Artificial Sequence
  Description of Artificial Sequence: Synthetic oligonucleotide
tcgggtgtagggtggtaccg

SEQ ID NO: 154 - DNA, 20 bp, Artificial Sequence
  Description of Artificial Sequence: Synthetic oligonucleotide
ttgggtgtagagtggtaccg

SEQ ID NO: 155 - DNA, 20 bp, Artificial Sequence
  Description of Artificial Sequence: Synthetic oligonucleotide
ttggatgtagggtggtaccg

SEQ ID NO: 156 - DNA, 20 bp, Artificial Sequence
  Description of Artificial Sequence: Synthetic oligonucleotide
tttgaagggggatgggaccg

SEQ ID NO: 157 - DNA, 20 bp, Artificial Sequence
  Description of Artificial Sequence: Synthetic oligonucleotide
gcctttcgttctggcctccc

SEQ ID NO: 158 - DNA, 20 bp, Artificial Sequence
  Description of Artificial Sequence: Synthetic oligonucleotide
attggagaagggaggtactg

SEQ ID NO: 159 - DNA, 20 bp, Artificial Sequence
  Description of Artificial Sequence: Synthetic oligonucleotide
attgggtgtagggagttccg

SEQ ID NO: 160 - DNA, 19 bp, Artificial Sequence
  Description of Artificial Sequence: Synthetic oligonucleotide
tgggtgtagggtggtaccg

SEQ ID NO: 161 - DNA, 20 bp, Artificial Sequence
  Description of Artificial Sequence: Synthetic oligonucleotide
tattggaggtgtagggtccg

SEQ ID NO: 162 - DNA, 20 bp, Artificial Sequence
  Description of Artificial Sequence: Synthetic oligonucleotide
ttgggtgtagggtagtaccg

SEQ ID NO: 163 - DNA, 20 bp, Artificial Sequence
  Description of Artificial Sequence: Synthetic oligonucleotide
gcatttcgttctgacctccc

SEQ ID NO: 164 - DNA, 19 bp, Artificial Sequence
  Description of Artificial Sequence: Synthetic oligonucleotide
gctttcgttctgccctccc

SEQ ID NO: 165 - DNA, 19 bp, Artificial Sequence
  Description of Artificial Sequence: Synthetic oligonucleotide
gccttcgttctgccctccc

SEQ ID NO: 166 - DNA, 20 bp, Artificial Sequence
  Description of Artificial Sequence: Synthetic oligonucleotide
ttgggtgtagtgtggtaccg

SEQ ID NO: 167 - DNA, 20 bp, Artificial Sequence
  Description of Artificial Sequence: Synthetic oligonucleotide
tatgaagggtgatgggtccg

SEQ ID NO: 168 - DNA, 20 bp, Artificial Sequence
  Description of Artificial Sequence: Synthetic oligonucleotide
attggtaaagggaggtactg

SEQ ID NO: 169 - DNA, 20 bp, Artificial Sequence
  Description of Artificial Sequence: Synthetic oligonucleotide
ttaggtgtagggtggtaccg

SEQ ID NO: 170 - DNA, 20 bp, Artificial Sequence
  Description of Artificial Sequence: Synthetic oligonucleotide
ttgggtgtaggatggtaccg

SEQ ID NO: 171 - DNA, 20 bp, Artificial Sequence
  Description of Artificial Sequence: Synthetic oligonucleotide
ttgggtgtagggtggtaccc

SEQ ID NO: 172 - DNA, 20 bp, Artificial Sequence
  Description of Artificial Sequence: Synthetic oligonucleotide
ttgggtgtaaggtggtaccg

SEQ ID NO: 173 - DNA, 20 bp, Artificial Sequence
  Description of Artificial Sequence: Synthetic oligonucleotide
gcccttcgttctgccctccc

SEQ ID NO: 174 - DNA, 20 bp, Artificial Sequence
  Description of Artificial Sequence: Synthetic oligonucleotide
tttgaaggctgatgggtccg

SEQ ID NO: 175 - DNA, 20 bp, Artificial Sequence
  Description of Artificial Sequence: Synthetic oligonucleotide
gcctttcgttctgtcctccc

SEQ ID NO: 176 - DNA, 18 bp, Artificial Sequence
  Description of Artificial Sequence: Synthetic oligonucleotide
tttgaagggtgatgtccg

SEQ ID NO: 177 - DNA, 20 bp, Artificial Sequence
  Description of Artificial Sequence: Synthetic oligonucleotide
atgggtgtagggtggtaccg

SEQ ID NO: 178 - DNA, 20 bp, Artificial Sequence
  Description of Artificial Sequence: Synthetic oligonucleotide
agtcttgtcgtttgtggcgc

SEQ ID NO: 179 - DNA, 20 bp, Artificial Sequence
  Description of Artificial Sequence: Synthetic oligonucleotide
tttgaagggtgatgcgtccg

SEQ ID NO: 180 - DNA, 20 bp, Artificial Sequence
  Description of Artificial Sequence: Synthetic oligonucleotide
tgtgaagggtgatgggtccg

SEQ ID NO: 181 - DNA, 19 bp, Artificial Sequence
  Description of Artificial Sequence: Synthetic oligonucleotide
tttgagggtgatgggtccg

SEQ ID NO: 182 - DNA, 20 bp, Artificial Sequence
  Description of Artificial Sequence: Synthetic oligonucleotide
tttgaagggtcatgggtccg

SEQ ID NO: 183 - DNA, 20 bp, Artificial Sequence
  Description of Artificial Sequence: Synthetic oligonucleotide
gccttcttctggttcgtccc

SEQ ID NO: 184 - DNA, 20 bp, Artificial Sequence
  Description of Artificial Sequence: Synthetic oligonucleotide
tttcaagggtgatgggtccg

SEQ ID NO: 185 - DNA, 20 bp, Artificial Sequence
  Description of Artificial Sequence: Synthetic oligonucleotide
gcctttcgttctgccctccg

SEQ ID NO: 186 - DNA, 19 bp, Artificial Sequence
  Description of Artificial Sequence: Synthetic oligonucleotide
gcctttcgttctgacctcc

SEQ ID NO: 187 - DNA, 20 bp, Artificial Sequence
  Description of Artificial Sequence: Synthetic oligonucleotide
ttgggtgttgggtggtaccg

SEQ ID NO: 188 - DNA, 19 bp, Artificial Sequence
  Description of Artificial Sequence: Synthetic oligonucleotide
ttggtgtagggtggtaccg

SEQ ID NO: 189 - DNA, 19 bp, Artificial Sequence
  Description of Artificial Sequence: Synthetic oligonucleotide
tttgaagggtgatgggccg

SEQ ID NO: 190 - DNA, 20 bp, Artificial Sequence
  Description of Artificial Sequence: Synthetic oligonucleotide
gcctttcgttctgttctccc

SEQ ID NO: 191 - DNA, 20 bp, Artificial Sequence
  Description of Artificial Sequence: Synthetic oligonucleotide
attggtgtagggaggtactg

SEQ ID NO: 192 - DNA, 20 bp, Artificial Sequence
  Description of Artificial Sequence: Synthetic oligonucleotide
ttgggtgtagggtggtacca

SEQ ID NO: 193 - DNA, 20 bp, Artificial Sequence
  Description of Artificial Sequence: Synthetic oligonucleotide
ttaaggtggtgtaggggccg

SEQ ID NO: 194 - DNA, 20 bp, Artificial Sequence
  Description of Artificial Sequence: Synthetic oligonucleotide
ttgagtgtagggtggtaccg

SEQ ID NO: 195 - DNA, 20 bp, Artificial Sequence
  Description of Artificial Sequence: Synthetic oligonucleotide
ttgggtggagggtggtaccg

SEQ ID NO: 196 - DNA, 20 bp, Artificial Sequence
  Description of Artificial Sequence: Synthetic oligonucleotide
gcctttcgttctgccctcct

SEQ ID NO: 197 - DNA, 19 bp, Artificial Sequence
  Description of Artificial Sequence: Synthetic oligonucleotide
gcctttcgtctgccctccc

SEQ ID NO: 198 - DNA, 20 bp, Artificial Sequence
  Description of Artificial Sequence: Synthetic oligonucleotide
ttgggtgtatggtggtaccg

SEQ ID NO: 199 - DNA, 20 bp, Artificial Sequence
  Description of Artificial Sequence: Synthetic oligonucleotide
gcctttcgttctgccccccc

SEQ ID NO: 200 - DNA, 20 bp, Artificial Sequence
  Description of Artificial Sequence: Synthetic oligonucleotide
gcctttcgttctgacctcca

SEQ ID NO: 201 - DNA, 20 bp, Artificial Sequence
  Description of Artificial Sequence: Synthetic oligonucleotide
attggtgaagggaagtactg

SEQ ID NO: 202 - DNA, 20 bp, Artificial Sequence
  Description of Artificial Sequence: Synthetic oligonucleotide
ttgggtgaagggaggtactg

SEQ ID NO: 203 - DNA, 20 bp, Artificial Sequence
  Description of Artificial Sequence: Synthetic oligonucleotide
attggggaagggaggtactg

SEQ ID NO: 204 - DNA, 19 bp, Artificial Sequence
  Description of Artificial Sequence: Synthetic oligonucleotide
cctttcgttctgccctccc

SEQ ID NO: 205 - DNA, 20 bp, Artificial Sequence
  Description of Artificial Sequence: Synthetic oligonucleotide
gcccttcgttctgacctccc

SEQ ID NO: 206 - DNA, 18 bp, Artificial Sequence
  Description of Artificial Sequence: Synthetic oligonucleotide
attggtgaagggaggttg

SEQ ID NO: 207 - DNA, 20 bp, Artificial Sequence
  Description of Artificial Sequence: Synthetic oligonucleotide
gcctttcgttctgccctcca

SEQ ID NO: 208 - DNA, 20 bp, Artificial Sequence
  Description of Artificial Sequence: Synthetic oligonucleotide
gccattcgtcttttcgtccc

SEQ ID NO: 209 - DNA, 20 bp, Artificial Sequence
  Description of Artificial Sequence: Synthetic oligonucleotide
ctgtgaggagcagggtggta

SEQ ID NO: 210 - DNA, 18 bp, Artificial Sequence
  Description of Artificial Sequence: Synthetic oligonucleotide
ttgggtagggtggtaccg

SEQ ID NO: 211 - DNA, 20 bp, Artificial Sequence
  Description of Artificial Sequence: Synthetic oligonucleotide
ttgggtgtagggtgataccg

SEQ ID NO: 212 - DNA, 20 bp, Artificial Sequence
  Description of Artificial Sequence: Synthetic oligonucleotide
tttgaagggtgaggggtccg

SEQ ID NO: 213 - DNA, 20 bp, Artificial Sequence
  Description of Artificial Sequence: Synthetic oligonucleotide
attggtgaagggagatactg

SEQ ID NO: 214 - DNA, 18 bp, Artificial Sequence
  Description of Artificial Sequence: Synthetic oligonucleotide
tttgaagggtgatgggtg

SEQ ID NO: 215 - DNA, 20 bp, Artificial Sequence
  Description of Artificial Sequence: Synthetic oligonucleotide
taggggtgtggggtgttatg

SEQ ID NO: 216 - DNA, 20 bp, Artificial Sequence
  Description of Artificial Sequence: Synthetic oligonucleotide
attggtgatgggaggtactg

SEQ ID NO: 217 - DNA, 20 bp, Artificial Sequence
  Description of Artificial Sequence: Synthetic oligonucleotide
attggtgaaaggaggtactg

SEQ ID NO: 218 - DNA, 18 bp, Artificial Sequence
  Description of Artificial Sequence: Synthetic oligonucleotide
tttgaagggtgatgggtc

SEQ ID NO: 219 - DNA, 20 bp, Artificial Sequence
  Description of Artificial Sequence: Synthetic oligonucleotide
gcctctcgttctgacctccc

SEQ ID NO: 220 - DNA, 20 bp, Artificial Sequence
  Description of Artificial Sequence: Synthetic oligonucleotide
attggtgaagggagctactg

SEQ ID NO: 221 - DNA, 20 bp, Artificial Sequence
  Description of Artificial Sequence: Synthetic oligonucleotide
attggtgaaggaaggtactg

SEQ ID NO: 222 - DNA, 20 bp, Artificial Sequence
  Description of Artificial Sequence: Synthetic oligonucleotide
attgatgaagggaggtactg

SEQ ID NO: 223 - DNA, 20 bp, Artificial Sequence
  Description of Artificial Sequence: Synthetic oligonucleotide
ttgggtgtagggtggaaccg

SEQ ID NO: 224 - DNA, 20 bp, Artificial Sequence
  Description of Artificial Sequence: Synthetic oligonucleotide
ctgtttgtaagggaggtggt

SEQ ID NO: 225 - DNA, 20 bp, Artificial Sequence
  Description of Artificial Sequence: Synthetic oligonucleotide
ttgggtgtagggtgctaccg

SEQ ID NO: 226 - DNA, 20 bp, Artificial Sequence
  Description of Artificial Sequence: Synthetic oligonucleotide
gcctttcgttctgaccttcc

SEQ ID NO: 227 - DNA, 20 bp, Artificial Sequence
  Description of Artificial Sequence: Synthetic oligonucleotide
gttggtgaagggaggtaccg

SEQ ID NO: 228 - DNA, 20 bp, Artificial Sequence
  Description of Artificial Sequence: Synthetic oligonucleotide
attagtgaagggaggtactg

SEQ ID NO: 229 - DNA, 20 bp, Artificial Sequence
  Description of Artificial Sequence: Synthetic oligonucleotide
ttgggtgtagggttgtaccg

SEQ ID NO: 230 - DNA, 20 bp, Artificial Sequence
  Description of Artificial Sequence: Synthetic oligonucleotide
attggtgaagagaggtactg

SEQ ID NO: 231 - DNA, 20 bp, Artificial Sequence
  Description of Artificial Sequence: Synthetic oligonucleotide
ttgggtgaagggtggtaccg

SEQ ID NO: 232 - DNA, 20 bp, Artificial Sequence
  Description of Artificial Sequence: Synthetic oligonucleotide
ttgggtgtagggtggtacgg

SEQ ID NO: 233 - DNA, 20 bp, Artificial Sequence
  Description of Artificial Sequence: Synthetic oligonucleotide
gcctttcgctctgccctccc

SEQ ID NO: 234 - DNA, 20 bp, Artificial Sequence
  Description of Artificial Sequence: Synthetic oligonucleotide
ttgggtgaagggaggtaccg

SEQ ID NO: 235 - DNA, 20 bp, Artificial Sequence
  Description of Artificial Sequence: Synthetic oligonucleotide
aatggtggagtagggatacg

SEQ ID NO: 236 - DNA, 20 bp, Artificial Sequence
  Description of Artificial Sequence: Synthetic oligonucleotide
tgaaggagtggggaggtccg

SEQ ID NO: 237 - DNA, 20 bp, Artificial Sequence
  Description of Artificial Sequence: Synthetic oligonucleotide
gcctctcgttctgccctccc

SEQ ID NO: 238 - DNA, 20 bp, Artificial Sequence
  Description of Artificial Sequence: Synthetic oligonucleotide
tattggaggtgtaggggccg

SEQ ID NO: 239 - DNA, 20 bp, Artificial Sequence
  Description of Artificial Sequence: Synthetic oligonucleotide
ttgggtatagggtggtaccg

SEQ ID NO: 240 - DNA, 19 bp, Artificial Sequence
  Description of Artificial Sequence: Synthetic oligonucleotide
tttaagggtgatgggtccg

SEQ ID NO: 241 - DNA, 20 bp, Artificial Sequence
  Description of Artificial Sequence: Synthetic oligonucleotide
tcctgtcgtccgttcgtccc

SEQ ID NO: 242 - DNA, 20 bp, Artificial Sequence
  Description of Artificial Sequence: Synthetic oligonucleotide
gcttttcgttctgacctccc

SEQ ID NO: 243 - DNA, 20 bp, Artificial Sequence
  Description of Artificial Sequence: Synthetic oligonucleotide
attggtgaagtgaggtactg

SEQ ID NO: 244 - DNA, 20 bp, Artificial Sequence
  Description of Artificial Sequence: Synthetic oligonucleotide
gcctttcgttctgccctttc

SEQ ID NO: 245 - DNA, 20 bp, Artificial Sequence
  Description of Artificial Sequence: Synthetic oligonucleotide
gcctttcgttctgccatccc

SEQ ID NO: 246 - DNA, 20 bp, Artificial Sequence
  Description of Artificial Sequence: Synthetic oligonucleotide
attggtgaatggaggtactg

SEQ ID NO: 247 - DNA, 20 bp, Artificial Sequence
  Description of Artificial Sequence: Synthetic oligonucleotide
attggtgaagggaggttctg

SEQ ID NO: 248 - DNA, 20 bp, Artificial Sequence
  Description of Artificial Sequence: Synthetic oligonucleotide
attggtgaagggagggaccg

SEQ ID NO: 249 - DNA, 20 bp, Artificial Sequence
  Description of Artificial Sequence: Synthetic oligonucleotide
ttggaagggtgatgggtccg

SEQ ID NO: 250 - DNA, 20 bp, Artificial Sequence
  Description of Artificial Sequence: Synthetic oligonucleotide
attggtggagggaggtaccg

SEQ ID NO: 251 - DNA, 20 bp, Artificial Sequence
  Description of Artificial Sequence: Synthetic oligonucleotide
tttggtgaagggaggtaccg

SEQ ID NO: 252 - DNA, 20 bp, Artificial Sequence
  Description of Artificial Sequence: Synthetic oligonucleotide
attggtgaagggaggtacgg

SEQ ID NO: 253 - DNA, 20 bp, Artificial Sequence
  Description of Artificial Sequence: Synthetic oligonucleotide
tttgaagggtgataagtccg

SEQ ID NO: 254 - DNA, 20 bp, Artificial Sequence
  Description of Artificial Sequence: Synthetic oligonucleotide
tttgaacggtgatgggtccg

SEQ ID NO: 255 - DNA, 20 bp, Artificial Sequence
  Description of Artificial Sequence: Synthetic oligonucleotide
gtctttcgttctgccctccc

SEQ ID NO: 256 - DNA, 20 bp, Artificial Sequence
  Description of Artificial Sequence: Synthetic oligonucleotide
acctttcgttctgccctccc

SEQ ID NO: 257 - DNA, 20 bp, Artificial Sequence
  Description of Artificial Sequence: Synthetic oligonucleotide
attggtgaagggaggtgccg

SEQ ID NO: 258 - DNA, 20 bp, Artificial Sequence
  Description of Artificial Sequence: Synthetic oligonucleotide
ttgggtttagggtggtaccg

SEQ ID NO: 259 - DNA, 19 bp, Artificial Sequence
  Description of Artificial Sequence: Synthetic oligonucleotide
tttgaaggggatgggtccg

SEQ ID NO: 260 - DNA, 20 bp, Artificial Sequence
  Description of Artificial Sequence: Synthetic oligonucleotide
gcctttcgttctgccctcac

SEQ ID NO: 261 - DNA, 20 bp, Artificial Sequence
  Description of Artificial Sequence: Synthetic oligonucleotide
tttgaagcgtgatgggtccg

SEQ ID NO: 262 - DNA, 20 bp, Artificial Sequence
  Description of Artificial Sequence: Synthetic oligonucleotide
tttgaaggggggtgggtccg

SEQ ID NO: 263 - DNA, 21 bp, Artificial Sequence
  Description of Artificial Sequence: Synthetic oligonucleotide
cagaggagaagggaggtactg

SEQ ID NO: 264 - DNA, 20 bp, Artificial Sequence
  Description of Artificial Sequence: Synthetic oligonucleotide
ttggttgtagggtggtaccg

SEQ ID NO: 265 - DNA, 20 bp, Artificial Sequence
  Description of Artificial Sequence: Synthetic oligonucleotide
attggtgaagggatgtactg

SEQ ID NO: 266 - DNA, 20 bp, Artificial Sequence
  Description of Artificial Sequence: Synthetic oligonucleotide
attggtgaagggaggtattg

SEQ ID NO: 267 - DNA, 20 bp, Artificial Sequence
  Description of Artificial Sequence: Synthetic oligonucleotide
ttgtgtgtagggtggtaccg

SEQ ID NO: 268 - DNA, 20 bp, Artificial Sequence
  Description of Artificial Sequence: Synthetic oligonucleotide
gcctttcgttttgccctccc

SEQ ID NO: 269 - DNA, 19 bp, Artificial Sequence
  Description of Artificial Sequence: Synthetic oligonucleotide
gcctttcgttctgcccccc

SEQ ID NO: 270 - DNA, 20 bp, Artificial Sequence
  Description of Artificial Sequence: Synthetic oligonucleotide
gcctttcgttctgatctccc

SEQ ID NO: 271 - DNA, 20 bp, Artificial Sequence
  Description of Artificial Sequence: Synthetic oligonucleotide
tttgaagggtgatcggtccg

SEQ ID NO: 272 - DNA, 20 bp, Artificial Sequence
  Description of Artificial Sequence: Synthetic oligonucleotide
gcctttcgttctgcactccc

SEQ ID NO: 273 - DNA, 20 bp, Artificial Sequence
  Description of Artificial Sequence: Synthetic oligonucleotide
attggcgaagggaggtaccg

SEQ ID NO: 274 - DNA, 20 bp, Artificial Sequence
  Description of Artificial Sequence: Synthetic oligonucleotide
aggtgtaggggggtgtaccg

SEQ ID NO: 275 - DNA, 20 bp, Artificial Sequence
  Description of Artificial Sequence: Synthetic oligonucleotide
attggtgaagggaggtacta

SEQ ID NO: 276 - DNA, 20 bp, Artificial Sequence
  Description of Artificial Sequence: Synthetic oligonucleotide
ttgggtgtaggttggtaccg

SEQ ID NO: 277 - DNA, 20 bp, Artificial Sequence
  Description of Artificial Sequence: Synthetic oligonucleotide
ttagaagggtgatgggtccg

SEQ ID NO: 278 - DNA, 20 bp, Artificial Sequence
  Description of Artificial Sequence: Synthetic oligonucleotide
attggtgaagggaggtacag

SEQ ID NO: 279 - DNA, 18 bp, Artificial Sequence
  Description of Artificial Sequence: Synthetic oligonucleotide
gcctttcgttcttctccc

SEQ ID NO: 280 - DNA, 20 bp, Artificial Sequence
  Description of Artificial Sequence: Synthetic oligonucleotide
gtgggtgtagggtggtaccg

SEQ ID NO: 281 - DNA, 20 bp, Artificial Sequence
  Description of Artificial Sequence: Synthetic oligonucleotide
ttgggtgtagggtggtatcg

SEQ ID NO: 282 - DNA, 19 bp, Artificial Sequence
  Description of Artificial Sequence: Synthetic oligonucleotide
gcctttcgtttgccctccc

SEQ ID NO: 283 - DNA, 20 bp, Artificial Sequence
  Description of Artificial Sequence: Synthetic oligonucleotide
gcctttcggtctgccctccc

SEQ ID NO: 284 - DNA, 19 bp, Artificial Sequence
  Description of Artificial Sequence: Synthetic oligonucleotide
ttgggtgtagggtgtaccg

SEQ ID NO: 285 - DNA, 19 bp, Artificial Sequence
  Description of Artificial Sequence: Synthetic oligonucleotide
gcctttcgtctgacctccc

SEQ ID NO: 286 - DNA, 20 bp, Artificial Sequence
  Description of Artificial Sequence: Synthetic oligonucleotide
tgtaggaggaggagggaccg

SEQ ID NO: 287 - DNA, 20 bp, Artificial Sequence
  Description of Artificial Sequence: Synthetic oligonucleotide
gcctttcgttctgccctgcc

SEQ ID NO: 288 - DNA, 20 bp, Artificial Sequence
  Description of Artificial Sequence: Synthetic oligonucleotide
attggtgaagggaggcaccg

SEQ ID NO: 289 - DNA, 20 bp, Artificial Sequence
  Description of Artificial Sequence: Synthetic oligonucleotide
gcctttcgttctgcccaccc

SEQ ID NO: 290 - DNA, 19 bp, Artificial Sequence
  Description of Artificial Sequence: Synthetic oligonucleotide
gctttcgttctgacctccc

SEQ ID NO: 291 - DNA, 20 bp, Artificial Sequence
  Description of Artificial Sequence: Synthetic oligonucleotide
tgtaggaggaggaggtgccg

SEQ ID NO: 292 - DNA, 20 bp, Artificial Sequence
  Description of Artificial Sequence: Synthetic oligonucleotide
attggttaagggaggtactg

SEQ ID NO: 293 - DNA, 20 bp, Artificial Sequence
  Description of Artificial Sequence: Synthetic oligonucleotide
gcctttcgttctgccctacc

SEQ ID NO: 294 - DNA, 20 bp, Artificial Sequence
  Description of Artificial Sequence: Synthetic oligonucleotide
cttggtgaagggaggtactg

SEQ ID NO: 295 - DNA, 20 bp, Artificial Sequence
  Description of Artificial Sequence: Synthetic oligonucleotide
attggtgaagggaggttccg

SEQ ID NO: 296 - DNA, 20 bp, Artificial Sequence
  Description of Artificial Sequence: Synthetic oligonucleotide
tcctgtcgtctgctcgtccc

SEQ ID NO: 297 - DNA, 20 bp, Artificial Sequence
  Description of Artificial Sequence: Synthetic oligonucleotide
attggtgaaggtaggtactg

SEQ ID NO: 298 - DNA, 20 bp, Artificial Sequence
  Description of Artificial Sequence: Synthetic oligonucleotide
ttgggtgtagggtggtacag

SEQ ID NO: 299 - DNA, 19 bp, Artificial Sequence
  Description of Artificial Sequence: Synthetic oligonucleotide
ttgggtgtaggtggtaccg

SEQ ID NO: 300 - DNA, 20 bp, Artificial Sequence
  Description of Artificial Sequence: Synthetic oligonucleotide
ttgggagtagggtgggaccg

SEQ ID NO: 301 - DNA, 20 bp, Artificial Sequence
  Description of Artificial Sequence: Synthetic oligonucleotide
ttgggtgtaggctggtaccg

SEQ ID NO: 302 - DNA, 20 bp, Artificial Sequence
  Description of Artificial Sequence: Synthetic oligonucleotide
gcctttcgttctgcgctccc

SEQ ID NO: 303 - DNA, 20 bp, Artificial Sequence
  Description of Artificial Sequence: Synthetic oligonucleotide
gcatttcgttctgccctccc

SEQ ID NO: 304 - DNA, 20 bp, Artificial Sequence
  Description of Artificial Sequence: Synthetic oligonucleotide
attggtgaggggaggtaccg

SEQ ID NO: 305 - DNA, 19 bp, Artificial Sequence
  Description of Artificial Sequence: Synthetic oligonucleotide
gcctttcgttctgaccccc

SEQ ID NO: 306 - DNA, 18 bp, Artificial Sequence
  Description of Artificial Sequence: Synthetic oligonucleotide
tgaagggtgatgggtccg

SEQ ID NO: 307 - DNA, 20 bp, Artificial Sequence
  Description of Artificial Sequence: Synthetic oligonucleotide
gcctttcgatctgccctccc

SEQ ID NO: 308 - DNA, 20 bp, Artificial Sequence
  Description of Artificial Sequence: Synthetic oligonucleotide
ccctgtcgtctgttcgtccc

SEQ ID NO: 309 - DNA, 20 bp, Artificial Sequence
  Description of Artificial Sequence: Synthetic oligonucleotide
gtaggtggagtaggggtccg

SEQ ID NO: 310 - DNA, 20 bp, Artificial Sequence
  Description of Artificial Sequence: Synthetic oligonucleotide
attggtgaagggaggtactt

SEQ ID NO: 311 - DNA, 20 bp, Artificial Sequence
  Description of Artificial Sequence: Synthetic oligonucleotide
gccttttgttctgccctccc

SEQ ID NO: 312 - DNA, 21 bp, Artificial Sequence
  Description of Artificial Sequence: Synthetic oligonucleotide
gccttttcgttctgccctccc

SEQ ID NO: 313 - DNA, 20 bp, Artificial Sequence
  Description of Artificial Sequence: Synthetic oligonucleotide
tttggagggggatgggtccg

SEQ ID NO: 314 - DNA, 20 bp, Artificial Sequence
  Description of Artificial Sequence: Synthetic oligonucleotide
tttgaagggtgatggtaccg

SEQ ID NO: 315 - DNA, 20 bp, Artificial Sequence
  Description of Artificial Sequence: Synthetic oligonucleotide
gcctttcgtcctgccctccc

SEQ ID NO: 316 - DNA, 20 bp, Artificial Sequence
  Description of Artificial Sequence: Synthetic oligonucleotide
gcctttcattctgccctccc

SEQ ID NO: 317 - DNA, 20 bp, Artificial Sequence
  Description of Artificial Sequence: Synthetic oligonucleotide
gcctttcgttctgacttccc

SEQ ID NO: 318 - DNA, 21 bp, Artificial Sequence
  Description of Artificial Sequence: Synthetic oligonucleotide
tttgaaggggtgatgggtccg

SEQ ID NO: 319 - DNA, 20 bp, Artificial Sequence
  Description of Artificial Sequence: Synthetic oligonucleotide
gcctttcgttctcccctccc

SEQ ID NO: 320 - DNA, 20 bp, Artificial Sequence
  Description of Artificial Sequence: Synthetic oligonucleotide
ttgggtctagggtggtaccg

SEQ ID NO: 321 - DNA, 20 bp, Artificial Sequence
  Description of Artificial Sequence: Synthetic oligonucleotide
gcctttcgctctgacctccc

SEQ ID NO: 322 - DNA, 20 bp, Artificial Sequence
  Description of Artificial Sequence: Synthetic oligonucleotide
gcctttcgttctaacctccc

SEQ ID NO: 323 - DNA, 19 bp, Artificial Sequence
  Description of Artificial Sequence: Synthetic oligonucleotide
gcctttcgttctgactccc

SEQ ID NO: 324 - DNA, 20 bp, Artificial Sequence
  Description of Artificial Sequence: Synthetic oligonucleotide
ttggctgtagggtggtaccg

SEQ ID NO: 325 - DNA, 20 bp, Artificial Sequence
  Description of Artificial Sequence: Synthetic oligonucleotide
attggtgaaggggggtaccg

SEQ ID NO: 326 - DNA, 19 bp, Artificial Sequence
  Description of Artificial Sequence: Synthetic oligonucleotide
gcctttcgttctccctccc

SEQ ID NO: 327 - DNA, 20 bp, Artificial Sequence
  Description of Artificial Sequence: Synthetic oligonucleotide
gcctttcgtcctgacctccc

SEQ ID NO: 328 - DNA, 20 bp, Artificial Sequence
  Description of Artificial Sequence: Synthetic oligonucleotide
tattggaggtgtaggtaccg

SEQ ID NO: 329 - DNA, 20 bp, Artificial Sequence
  Description of Artificial Sequence: Synthetic oligonucleotide
tcctgtcgtctcttcgtccc

SEQ ID NO: 330 - DNA, 20 bp, Artificial Sequence
  Description of Artificial Sequence: Synthetic oligonucleotide
ttgggtgtagggtgttgccg

SEQ ID NO: 331 - DNA, 20 bp, Artificial Sequence
  Description of Artificial Sequence: Synthetic oligonucleotide
tggtgtgtcaaggtacgcgc

SEQ ID NO: 332 - DNA, 20 bp, Artificial Sequence
  Description of Artificial Sequence: Synthetic oligonucleotide
atgggtgaagggaggtactg

SEQ ID NO: 333 - DNA, 19 bp, Artificial Sequence
  Description of Artificial Sequence: Synthetic oligonucleotide
tcctgtcgtctgttgtccc

SEQ ID NO: 334 - DNA, 19 bp, Artificial Sequence
  Description of Artificial Sequence: Synthetic oligonucleotide
tttgaagggtgatgggtcc

SEQ ID NO: 335 - DNA, 20 bp, Artificial Sequence
  Description of Artificial Sequence: Synthetic oligonucleotide
tggggtgtagggtggtaccg

SEQ ID NO: 336 - DNA, 20 bp, Artificial Sequence
  Description of Artificial Sequence: Synthetic oligonucleotide
tttggagggggatgggaccg

SEQ ID NO: 337 - DNA, 20 bp, Artificial Sequence
  Description of Artificial Sequence: Synthetic oligonucleotide
gcctttcgttcagccctccc

SEQ ID NO: 338 - DNA, 20 bp, Artificial Sequence
  Description of Artificial Sequence: Synthetic oligonucleotide
ttgggtgtagggtggtacct

SEQ ID NO: 339 - DNA, 20 bp, Artificial Sequence
  Description of Artificial Sequence: Synthetic oligonucleotide
tttgaagggtgatgggtttg

SEQ ID NO: 340 - DNA, 20 bp, Artificial Sequence
  Description of Artificial Sequence: Synthetic oligonucleotide
acctttcgttctgacctccc

SEQ ID NO: 341 - DNA, 20 bp, Artificial Sequence
  Description of Artificial Sequence: Synthetic oligonucleotide
gcctttcgttctgacctccg

SEQ ID NO: 342 - DNA, 20 bp, Artificial Sequence
  Description of Artificial Sequence: Synthetic oligonucleotide
tcctgttgtctgttcgtccc

SEQ ID NO: 343 - DNA, 20 bp, Artificial Sequence
  Description of Artificial Sequence: Synthetic oligonucleotide
gcctttcgttctgacctcac

SEQ ID NO: 344 - DNA, 20 bp, Artificial Sequence
  Description of Artificial Sequence: Synthetic oligonucleotide
gcctttcgttccgccctccc

SEQ ID NO: 345 - DNA, 20 bp, Artificial Sequence
  Description of Artificial Sequence: Synthetic oligonucleotide
gcctttctttctgccctccc

SEQ ID NO: 346 - DNA, 20 bp, Artificial Sequence
  Description of Artificial Sequence: Synthetic oligonucleotide
gcctttcgttctgactcccc

SEQ ID NO: 347 - DNA, 20 bp, Artificial Sequence
  Description of Artificial Sequence: Synthetic oligonucleotide
ataggtgaagggaggtactg

SEQ ID NO: 348 - DNA, 20 bp, Artificial Sequence
  Description of Artificial Sequence: Synthetic oligonucleotide
attggtgaagggcggtactg

SEQ ID NO: 349 - DNA, 20 bp, Artificial Sequence
  Description of Artificial Sequence: Synthetic oligonucleotide
ttgggtgtagggtggtcccg

SEQ ID NO: 350 - DNA, 20 bp, Artificial Sequence
  Description of Artificial Sequence: Synthetic oligonucleotide
gcctttcgttatgccctccc

SEQ ID NO: 351 - DNA, 20 bp, Artificial Sequence
  Description of Artificial Sequence: Synthetic oligonucleotide
atttgtgaagggaggtactg

SEQ ID NO: 352 - DNA, 20 bp, Artificial Sequence
  Description of Artificial Sequence: Synthetic oligonucleotide
atcttacactgcagataccc

SEQ ID NO: 353 - DNA, 20 bp, Artificial Sequence
  Description of Artificial Sequence: Synthetic oligonucleotide
attgttgaagggaggtactg

SEQ ID NO: 354 - DNA, 20 bp, Artificial Sequence
  Description of Artificial Sequence: Synthetic oligonucleotide
tttgaaggggggtgggaccg

SEQ ID NO: 355 - DNA, 20 bp, Artificial Sequence
  Description of Artificial Sequence: Synthetic oligonucleotide
gccttccgttctgccctccc

SEQ ID NO: 356 - DNA, 20 bp, Artificial Sequence
  Description of Artificial Sequence: Synthetic oligonucleotide
tcctttcgttctgacctccc

SEQ ID NO: 357 - DNA, 18 bp, Artificial Sequence
  Description of Artificial Sequence: Synthetic oligonucleotide
gcctttcgttctcctccc

SEQ ID NO: 358 - DNA, 20 bp, Artificial Sequence
  Description of Artificial Sequence: Synthetic oligonucleotide
ttgggaggagggtgggaccg

SEQ ID NO: 359 - DNA, 20 bp, Artificial Sequence
  Description of Artificial Sequence: Synthetic oligonucleotide
cgtggtggtgaaggggtacg

SEQ ID NO: 360 - DNA, 19 bp, Artificial Sequence
  Description of Artificial Sequence: Synthetic oligonucleotide
attgtgaagggaggtactg

SEQ ID NO: 361 - DNA, 20 bp, Artificial Sequence
  Description of Artificial Sequence: Synthetic oligonucleotide
cttgaagggggatgggtccg

SEQ ID NO: 362 - DNA, 20 bp, Artificial Sequence
  Description of Artificial Sequence: Synthetic oligonucleotide
attggtgaagggaggaaccg

SEQ ID NO: 363 - DNA, 21 bp, Artificial Sequence
  Description of Artificial Sequence: Synthetic oligonucleotide
tttgaagggtgattgggtccg

SEQ ID NO: 364 - DNA, 20 bp, Artificial Sequence
  Description of Artificial Sequence: Synthetic oligonucleotide
gcctttcgttctgacccccc

SEQ ID NO: 365 - DNA, 20 bp, Artificial Sequence
  Description of Artificial Sequence: Synthetic oligonucleotide
gccattcgttctgccctccc

SEQ ID NO: 366 - DNA, 21 bp, Artificial Sequence
  Description of Artificial Sequence: Synthetic oligonucleotide
ttttgaagggtgatgggtcct

SEQ ID NO: 367 - DNA, 20 bp, Artificial Sequence
  Description of Artificial Sequence: Synthetic oligonucleotide
gcctttcgttctgacatccc

SEQ ID NO: 368 - DNA, 20 bp, Artificial Sequence
  Description of Artificial Sequence: Synthetic oligonucleotide
taaggtggtgatgggattcg

SEQ ID NO: 369 - DNA, 20 bp, Artificial Sequence
  Description of Artificial Sequence: Synthetic oligonucleotide
agttggagaagggtggtctg

SEQ ID NO: 370 - DNA, 20 bp, Artificial Sequence
  Description of Artificial Sequence: Synthetic oligonucleotide
tttggaggagggtgggaccg

SEQ ID NO: 371 - DNA, 19 bp, Artificial Sequence
  Description of Artificial Sequence: Synthetic oligonucleotide
tccttcgtctgttcgtccc

SEQ ID NO: 372 - DNA, 20 bp, Artificial Sequence
  Description of Artificial Sequence: Synthetic oligonucleotide
aatggtgaagggaggtactg

SEQ ID NO: 373 - DNA, 20 bp, Artificial Sequence
  Description of Artificial Sequence: Synthetic oligonucleotide
gcctttcgttctgccctcgc

SEQ ID NO: 374 - DNA, 20 bp, Artificial Sequence
  Description of Artificial Sequence: Synthetic oligonucleotide
tgtaggaggaggaggcaccg

SEQ ID NO: 375 - DNA, 19 bp, Artificial Sequence
  Description of Artificial Sequence: Synthetic oligonucleotide
attggtgaagggagtactg

SEQ ID NO: 376 - DNA, 19 bp, Artificial Sequence
  Description of Artificial Sequence: Synthetic oligonucleotide
ttgggtgtagggtggtccg

SEQ ID NO: 377 - DNA, 20 bp, Artificial Sequence
  Description of Artificial Sequence: Synthetic oligonucleotide
cctcatgtttggctttcgtc

SEQ ID NO: 378 - DNA, 20 bp, Artificial Sequence
  Description of Artificial Sequence: Synthetic oligonucleotide
gactttcgttctgacctccc

SEQ ID NO: 379 - DNA, 19 bp, Artificial Sequence
  Description of Artificial Sequence: Synthetic oligonucleotide
ttggggtagggtggtaccg

SEQ ID NO: 380 - DNA, 19 bp, Artificial Sequence
  Description of Artificial Sequence: Synthetic oligonucleotide
tttggggttttcccgtgcc

SEQ ID NO: 381 - DNA, 20 bp, Artificial Sequence
  Description of Artificial Sequence: Synthetic oligonucleotide
gcctttagttctgccctccc

SEQ ID NO: 382 - DNA, 20 bp, Artificial Sequence
  Description of Artificial Sequence: Synthetic oligonucleotide
attggagaagggagggactg

SEQ ID NO: 383 - DNA, 21 bp, Artificial Sequence
  Description of Artificial Sequence: Synthetic oligonucleotide
tgttgaagggtgatgggtccg

SEQ ID NO: 384 - DNA, 20 bp, Artificial Sequence
  Description of Artificial Sequence: Synthetic oligonucleotide
gcctttcgttctgacctctc

SEQ ID NO: 385 - DNA, 20 bp, Artificial Sequence
  Description of Artificial Sequence: Synthetic oligonucleotide
gcctatcgttctgccctccc

SEQ ID NO: 386 - DNA, 21 bp, Artificial Sequence
  Description of Artificial Sequence: Synthetic oligonucleotide
tttgaagggtgatggggtccg

SEQ ID NO: 387 - DNA, 20 bp, Artificial Sequence
  Description of Artificial Sequence: Synthetic oligonucleotide
cgactcctctgttccctccc

SEQ ID NO: 388 - DNA, 20 bp, Artificial Sequence
  Description of Artificial Sequence: Synthetic oligonucleotide
gcctttcgttctgacctcct

SEQ ID NO: 389 - DNA, 21 bp, Artificial Sequence
  Description of Artificial Sequence: Synthetic oligonucleotide
tttgggtgtagggtggtaccg

SEQ ID NO: 390 - DNA, 20 bp, Artificial Sequence
  Description of Artificial Sequence: Synthetic oligonucleotide
tgtaggaggaggtggtaccg

SEQ ID NO: 391 - DNA, 20 bp, Artificial Sequence
  Description of Artificial Sequence: Synthetic oligonucleotide
tagggtgtagggtggtaccg

SEQ ID NO: 392 - DNA, 20 bp, Artificial Sequence
  Description of Artificial Sequence: Synthetic oligonucleotide
ttgggtggagggtgggaccg

SEQ ID NO: 393 - DNA, 20 bp, Artificial Sequence
  Description of Artificial Sequence: Synthetic oligonucleotide
gcctttcgttccgacctccc

SEQ ID NO: 394 - DNA, 20 bp, Artificial Sequence
  Description of Artificial Sequence: Synthetic oligonucleotide
attggtgtagggtggtactg

SEQ ID NO: 395 - DNA, 19 bp, Artificial Sequence
  Description of Artificial Sequence: Synthetic oligonucleotide
cctttcgttctgacctccc

SEQ ID NO: 396 - DNA, 19 bp, Artificial Sequence
  Description of Artificial Sequence: Synthetic oligonucleotide
atggtgaagggaggtaccg

SEQ ID NO: 397 - DNA, 20 bp, Artificial Sequence
  Description of Artificial Sequence: Synthetic oligonucleotide
gcctttcgttctgccgtccc

SEQ ID NO: 398 - DNA, 20 bp, Artificial Sequence
  Description of Artificial Sequence: Synthetic oligonucleotide
tcccgtcgtctgttcgtccc

SEQ ID NO: 399 - DNA, 19 bp, Artificial Sequence
  Description of Artificial Sequence: Synthetic oligonucleotide
attggtaagggaggtactg

SEQ ID NO: 400 - DNA, 19 bp, Artificial Sequence
  Description of Artificial Sequence: Synthetic oligonucleotide
gactgtatggggctctgtg

SEQ ID NO: 401 - DNA, 20 bp, Artificial Sequence
  Description of Artificial Sequence: Synthetic oligonucleotide
gcgtttcctctgttcgtccc

SEQ ID NO: 402 - DNA, 19 bp, Artificial Sequence
  Description of Artificial Sequence: Synthetic oligonucleotide
tttgaagggtgatgggttg

SEQ ID NO: 403 - DNA, 19 bp, Artificial Sequence
  Description of Artificial Sequence: Synthetic oligonucleotide
attggtgaagggaggtccg

SEQ ID NO: 404 - DNA, 20 bp, Artificial Sequence
  Description of Artificial Sequence: Synthetic oligonucleotide
tcctgtcgtctgttcgttcc

SEQ ID NO: 405 - DNA, 20 bp, Artificial Sequence
  Description of Artificial Sequence: Synthetic oligonucleotide
tttgaagggcggtgggtccg

SEQ ID NO: 406 - DNA, 20 bp, Artificial Sequence
  Description of Artificial Sequence: Synthetic oligonucleotide
tttgaagggaggtgggtccg

SEQ ID NO: 407 - DNA, 18 bp, Artificial Sequence
  Description of Artificial Sequence: Synthetic oligonucleotide
caggagaagggaggttgc

SEQ ID NO: 408 - DNA, 20 bp, Artificial Sequence
  Description of Artificial Sequence: Synthetic oligonucleotide
attggtgcagggaggtactg

SEQ ID NO: 409 - DNA, 20 bp, Artificial Sequence
  Description of Artificial Sequence: Synthetic oligonucleotide
tgtaggaggagggggtaccg

SEQ ID NO: 410 - DNA, 20 bp, Artificial Sequence
  Description of Artificial Sequence: Synthetic oligonucleotide
cagaggagaagggaggatgc

SEQ ID NO: 411 - DNA, 20 bp, Artificial Sequence
  Description of Artificial Sequence: Synthetic oligonucleotide
atcggtgaagggaggtaccg

SEQ ID NO: 412 - DNA, 19 bp, Artificial Sequence
  Description of Artificial Sequence: Synthetic oligonucleotide
tttggggtttcccgtgccc

SEQ ID NO: 413 - DNA, 20 bp, Artificial Sequence
  Description of Artificial Sequence: Synthetic oligonucleotide
ttgggtgtcgggtggtaccg

SEQ ID NO: 414 - DNA, 20 bp, Artificial Sequence
  Description of Artificial Sequence: Synthetic oligonucleotide
gcctttcattctgacctccc

SEQ ID NO: 415 - DNA, 21 bp, Artificial Sequence
  Description of Artificial Sequence: Synthetic oligonucleotide
ttagggtgtagggtggtaccg

SEQ ID NO: 416 - DNA, 19 bp, Artificial Sequence
  Description of Artificial Sequence: Synthetic oligonucleotide
tttgaagggtggtggtccg

SEQ ID NO: 417 - DNA, 20 bp, Artificial Sequence
  Description of Artificial Sequence: Synthetic oligonucleotide
ccctttcgttctgacctccc

SEQ ID NO: 418 - DNA, 20 bp, Artificial Sequence
  Description of Artificial Sequence: Synthetic oligonucleotide
cgatgcttacgtgcacgcgc

SEQ ID NO: 419 - DNA, 20 bp, Artificial Sequence
  Description of Artificial Sequence: Synthetic oligonucleotide
cagaggagaagggagggtgc

SEQ ID NO: 420 - DNA, 20 bp, Artificial Sequence
  Description of Artificial Sequence: Synthetic oligonucleotide
attggtgaagggaggtactc

SEQ ID NO: 421 - DNA, 20 bp, Artificial Sequence
  Description of Artificial Sequence: Synthetic oligonucleotide
attggtgtagggaggtaccg

SEQ ID NO: 422 - DNA, 20 bp, Artificial Sequence
  Description of Artificial Sequence: Synthetic oligonucleotide
attggagaagggaggtaccg

SEQ ID NO: 423 - DNA, 20 bp, Artificial Sequence
  Description of Artificial Sequence: Synthetic oligonucleotide
ttgggaggagggtggtaccg

SEQ ID NO: 424 - DNA, 20 bp, Artificial Sequence
  Description of Artificial Sequence: Synthetic oligonucleotide
atcctggtcgtcttacactg

SEQ ID NO: 425 - DNA, 20 bp, Artificial Sequence
  Description of Artificial Sequence: Synthetic oligonucleotide
gccttttgttctgacctccc

SEQ ID NO: 426 - DNA, 20 bp, Artificial Sequence
  Description of Artificial Sequence: Synthetic oligonucleotide
tttggaggggggtgggaccg

SEQ ID NO: 427 - DNA, 20 bp, Artificial Sequence
  Description of Artificial Sequence: Synthetic oligonucleotide
gcctttcgttctgacctacc

SEQ ID NO: 428 - DNA, 20 bp, Artificial Sequence
  Description of Artificial Sequence: Synthetic oligonucleotide
gccttccgttctgacctccc

SEQ ID NO: 429 - DNA, 20 bp, Artificial Sequence
  Description of Artificial Sequence: Synthetic oligonucleotide
tttgaagggtggtgggaccg

SEQ ID NO: 430 - DNA, 20 bp, Artificial Sequence
  Description of Artificial Sequence: Synthetic oligonucleotide
atagggagaagggtggaccg

SEQ ID NO: 431 - DNA, 20 bp, Artificial Sequence
  Description of Artificial Sequence: Synthetic oligonucleotide
gactttcgttctgccctccc

SEQ ID NO: 432 - DNA, 20 bp, Artificial Sequence
  Description of Artificial Sequence: Synthetic oligonucleotide
cagaggagaaggggggttgc

SEQ ID NO: 433 - DNA, 18 bp, Artificial Sequence
  Description of Artificial Sequence: Synthetic oligonucleotide
gcctttcgttctgccctc

SEQ ID NO: 434 - DNA, 19 bp, Artificial Sequence
  Description of Artificial Sequence: Synthetic oligonucleotide
tcctgtgtctgttcgtccc

SEQ ID NO: 435 - DNA, 20 bp, Artificial Sequence
  Description of Artificial Sequence: Synthetic oligonucleotide
tattggaggcgtagggaccg

SEQ ID NO: 436 - DNA, 20 bp, Artificial Sequence
  Description of Artificial Sequence: Synthetic oligonucleotide
gtctttcgttctgacctccc

SEQ ID NO: 437 - DNA, 20 bp, Artificial Sequence
  Description of Artificial Sequence: Synthetic oligonucleotide
tgtaggaggaggaggaaccg

SEQ ID NO: 438 - DNA, 20 bp, Artificial Sequence
  Description of Artificial Sequence: Synthetic oligonucleotide
gcctttcgatctgacctccc

SEQ ID NO: 439 - DNA, 20 bp, Artificial Sequence
  Description of Artificial Sequence: Synthetic oligonucleotide
tgtaggagggggaggtaccg

SEQ ID NO: 440 - DNA, 20 bp, Artificial Sequence
  Description of Artificial Sequence: Synthetic oligonucleotide
cagtggagaagggaggttgc

SEQ ID NO: 441 - DNA, 20 bp, Artificial Sequence
  Description of Artificial Sequence: Synthetic oligonucleotide
caggagaagggaggtggcat

SEQ ID NO: 442 - DNA, 20 bp, Artificial Sequence
  Description of Artificial Sequence: Synthetic oligonucleotide
attggtgacgggaggtactg

SEQ ID NO: 443 - DNA, 19 bp, Artificial Sequence
  Description of Artificial Sequence: Synthetic oligonucleotide
attggtgaaggaggtactg

SEQ ID NO: 444 - DNA, 20 bp, Artificial Sequence
  Description of Artificial Sequence: Synthetic oligonucleotide
gcctttcgttatgacctccc

SEQ ID NO: 445 - DNA, 20 bp, Artificial Sequence
  Description of Artificial Sequence: Synthetic oligonucleotide
tcctgtcgcctgttcgtccc

SEQ ID NO: 446 - DNA, 20 bp, Artificial Sequence
  Description of Artificial Sequence: Synthetic oligonucleotide
ccctttcgttctgccctccc

SEQ ID NO: 447 - DNA, 20 bp, Artificial Sequence
  Description of Artificial Sequence: Synthetic oligonucleotide
attggtgaagggaggtaatg

SEQ ID NO: 448 - DNA, 20 bp, Artificial Sequence
  Description of Artificial Sequence: Synthetic oligonucleotide
caggggagaagggaggttgc

SEQ ID NO: 449 - DNA, 20 bp, Artificial Sequence
  Description of Artificial Sequence: Synthetic oligonucleotide
gcctttcgttctgcccgccc

SEQ ID NO: 450 - DNA, 20 bp, Artificial Sequence
  Description of Artificial Sequence: Synthetic oligonucleotide
attggtgaagggaggtcctg

SEQ ID NO: 451 - DNA, 20 bp, Artificial Sequence
  Description of Artificial Sequence: Synthetic oligonucleotide
tattggaggtgtagggactg

SEQ ID NO: 452 - DNA, 21 bp, Artificial Sequence
  Description of Artificial Sequence: Synthetic oligonucleotide
tttggggtttttcccgtgccc

SEQ ID NO: 453 - DNA, 20 bp, Artificial Sequence
  Description of Artificial Sequence: Synthetic oligonucleotide
tgctgtcgtctgttcgtccc

SEQ ID NO: 454 - DNA, 20 bp, Artificial Sequence
  Description of Artificial Sequence: Synthetic oligonucleotide
tcctgtcttctgttcgtccc

SEQ ID NO: 455 - DNA, 20 bp, Artificial Sequence
  Description of Artificial Sequence: Synthetic oligonucleotide
tcctgtcgtctgttcgtccg

SEQ ID NO: 456 - DNA, 18 bp, Artificial Sequence
  Description of Artificial Sequence: Synthetic oligonucleotide
gcctttcgttgacctccc

SEQ ID NO: 457 - DNA, 18 bp, Artificial Sequence
  Description of Artificial Sequence: Synthetic oligonucleotide
ttgggtgtagggttaccg

SEQ ID NO: 458 - DNA, 20 bp, Artificial Sequence
  Description of Artificial Sequence: Synthetic oligonucleotide
tttgaagggtgatgcgtccc

SEQ ID NO: 459 - DNA, 20 bp, Artificial Sequence
  Description of Artificial Sequence: Synthetic oligonucleotide
cagaggagaagggaggctgc

SEQ ID NO: 460 - DNA, 19 bp, Artificial Sequence
  Description of Artificial Sequence: Synthetic oligonucleotide
gcctttcgtttgacctccc

SEQ ID NO: 461 - DNA, 19 bp, Artificial Sequence
  Description of Artificial Sequence: Synthetic oligonucleotide
tcctgtcgtctgtcgtccc

SEQ ID NO: 462 - DNA, 20 bp, Artificial Sequence
  Description of Artificial Sequence: Synthetic oligonucleotide
tgtagggggaggaggtaccg

SEQ ID NO: 463 - DNA, 20 bp, Artificial Sequence
  Description of Artificial Sequence: Synthetic oligonucleotide
attggtgaagggacgtactg

SEQ ID NO: 464 - DNA, 20 bp, Artificial Sequence
  Description of Artificial Sequence: Synthetic oligonucleotide
tgtaggaggaggaggttccg

SEQ ID NO: 465 - DNA, 20 bp, Artificial Sequence
  Description of Artificial Sequence: Synthetic oligonucleotide
gcctttcgttcttacctccc

SEQ ID NO: 466 - DNA, 20 bp, Artificial Sequence
  Description of Artificial Sequence: Synthetic oligonucleotide
attggtaaagggaggtaccg

SEQ ID NO: 467 - DNA, 20 bp, Artificial Sequence
  Description of Artificial Sequence: Synthetic oligonucleotide
cagaggtgaagggaggttgc

SEQ ID NO: 468 - DNA, 20 bp, Artificial Sequence
  Description of Artificial Sequence: Synthetic oligonucleotide
ataggtgtagggaggtttag

SEQ ID NO: 469 - DNA, 19 bp, Artificial Sequence
  Description of Artificial Sequence: Synthetic oligonucleotide
gcctttgttctgccctccc

SEQ ID NO: 470 - DNA, 21 bp, Artificial Sequence
  Description of Artificial Sequence: Synthetic oligonucleotide
ttgggtgtagggtggttaccg

SEQ ID NO: 471 - DNA, 20 bp, Artificial Sequence
  Description of Artificial Sequence: Synthetic oligonucleotide
attggtgaagggagttaccg

SEQ ID NO: 472 - DNA, 19 bp, Artificial Sequence
  Description of Artificial Sequence: Synthetic oligonucleotide
tttgaagggtgatggggtg

SEQ ID NO: 473 - DNA, 20 bp, Artificial Sequence
  Description of Artificial Sequence: Synthetic oligonucleotide
gccttacgttctgccctccc

SEQ ID NO: 474 - DNA, 20 bp, Artificial Sequence
  Description of Artificial Sequence: Synthetic oligonucleotide
ttgggtgtagggtgggtccg

SEQ ID NO: 475 - DNA, 20 bp, Artificial Sequence
  Description of Artificial Sequence: Synthetic oligonucleotide
atagggagaagggtgatccg

SEQ ID NO: 476 - DNA, 20 bp, Artificial Sequence
  Description of Artificial Sequence: Synthetic oligonucleotide
agtggtgaagggaggtactg

SEQ ID NO: 477 - DNA, 20 bp, Artificial Sequence
  Description of Artificial Sequence: Synthetic oligonucleotide
cagaggaggagggaggttgc

SEQ ID NO: 478 - DNA, 20 bp, Artificial Sequence
  Description of Artificial Sequence: Synthetic oligonucleotide
tgtaggaggaggagttaccg

SEQ ID NO: 479 - DNA, 19 bp, Artificial Sequence
  Description of Artificial Sequence: Synthetic oligonucleotide
tttgaagggtatgggtccg

SEQ ID NO: 480 - DNA, 20 bp, Artificial Sequence
  Description of Artificial Sequence: Synthetic oligonucleotide
cataggagaagggaggttgc

SEQ ID NO: 481 - DNA, 20 bp, Artificial Sequence
  Description of Artificial Sequence: Synthetic oligonucleotide
gatcatgctttcccttcgtc

SEQ ID NO: 482 - DNA, 20 bp, Artificial Sequence
  Description of Artificial Sequence: Synthetic oligonucleotide
cagaggagaagggtggttgc

SEQ ID NO: 483 - DNA, 20 bp, Artificial Sequence
  Description of Artificial Sequence: Synthetic oligonucleotide
tttgaagggtggtgggtccc

SEQ ID NO: 484 - DNA, 20 bp, Artificial Sequence
  Description of Artificial Sequence: Synthetic oligonucleotide
ttcggtgtagggtggtaccg

SEQ ID NO: 485 - DNA, 20 bp, Artificial Sequence
  Description of Artificial Sequence: Synthetic oligonucleotide
cgtttcctctggttcgtcac

SEQ ID NO: 486 - DNA, 20 bp, Artificial Sequence
  Description of Artificial Sequence: Synthetic oligonucleotide
ctgtccttattctgcaggtc

SEQ ID NO: 487 - DNA, 20 bp, Artificial Sequence
  Description of Artificial Sequence: Synthetic oligonucleotide
tttggggtttccccgtgccc

SEQ ID NO: 488 - DNA, 21 bp, Artificial Sequence
  Description of Artificial Sequence: Synthetic oligonucleotide
gcctttcgttctgacctcccc

SEQ ID NO: 489 - DNA, 18 bp, Artificial Sequence
  Description of Artificial Sequence: Synthetic oligonucleotide
tttgaagggatgggtccg

SEQ ID NO: 490 - DNA, 20 bp, Artificial Sequence
  Description of Artificial Sequence: Synthetic oligonucleotide
cgtaggaggaggaggtaccg

SEQ ID NO: 491 - DNA, 20 bp, Artificial Sequence
  Description of Artificial Sequence: Synthetic oligonucleotide
aatcgttctcctcgtctggc

SEQ ID NO: 492 - DNA, 20 bp, Artificial Sequence
  Description of Artificial Sequence: Synthetic oligonucleotide
gcctttcgttctcttctccc

SEQ ID NO: 493 - DNA, 20 bp, Artificial Sequence
  Description of Artificial Sequence: Synthetic oligonucleotide
tttggagtagggtggtaccg

SEQ ID NO: 494 - DNA, 20 bp, Artificial Sequence
  Description of Artificial Sequence: Synthetic oligonucleotide
agttggtggaggtggtttcg

SEQ ID NO: 495 - DNA, 20 bp, Artificial Sequence
  Description of Artificial Sequence: Synthetic oligonucleotide
gcctttcgttctgagctccc

SEQ ID NO: 496 - DNA, 18 bp, Artificial Sequence
  Description of Artificial Sequence: Synthetic oligonucleotide
gcctttcgttctgacctc

SEQ ID NO: 497 - DNA, 21 bp, Artificial Sequence
  Description of Artificial Sequence: Synthetic oligonucleotide
gtcctgtcgtctgctcgtccc

SEQ ID NO: 498 - DNA, 20 bp, Artificial Sequence
  Description of Artificial Sequence: Synthetic oligonucleotide
gatgacggcggttgtcttac

SEQ ID NO: 499 - DNA, 20 bp, Artificial Sequence
  Description of Artificial Sequence: Synthetic oligonucleotide
actggtgaagggaggtaccg

SEQ ID NO: 500 - DNA, 20 bp, Artificial Sequence
  Description of Artificial Sequence: Synthetic oligonucleotide
tttgcagggcgatgggtccg

SEQ ID NO: 501 - DNA, 20 bp, Artificial Sequence
  Description of Artificial Sequence: Synthetic oligonucleotide
ttgggggtaggggggtaccg

SEQ ID NO: 502 - DNA, 20 bp, Artificial Sequence
  Description of Artificial Sequence: Synthetic oligonucleotide
gcctttagttctgacctccc

SEQ ID NO: 503 - DNA, 20 bp, Artificial Sequence
  Description of Artificial Sequence: Synthetic oligonucleotide
gcctttcggtctgacctccc

SEQ ID NO: 504 - DNA, 20 bp, Artificial Sequence
  Description of Artificial Sequence: Synthetic oligonucleotide
ttgggtgtagggtggtaacg

SEQ ID NO: 505 - DNA, 20 bp, Artificial Sequence
  Description of Artificial Sequence: Synthetic oligonucleotide
tgtaggaggtggaggtaccg

SEQ ID NO: 506 - DNA, 20 bp, Artificial Sequence
  Description of Artificial Sequence: Synthetic oligonucleotide
tttgaaaagtgatgggtccg

SEQ ID NO: 507 - DNA, 20 bp, Artificial Sequence
  Description of Artificial Sequence: Synthetic oligonucleotide
gcctttcgttcggccctccc

SEQ ID NO: 508 - DNA, 20 bp, Artificial Sequence
  Description of Artificial Sequence: Synthetic oligonucleotide
cagaggggaagggaggttgc

SEQ ID NO: 509 - DNA, 19 bp, Artificial Sequence
  Description of Artificial Sequence: Synthetic oligonucleotide
tccttgtcgtcttgcgccc

SEQ ID NO: 510 - DNA, 20 bp, Artificial Sequence
  Description of Artificial Sequence: Synthetic oligonucleotide
gcctttcgttctgacgtccc

SEQ ID NO: 511 - DNA, 21 bp, Artificial Sequence
  Description of Artificial Sequence: Synthetic oligonucleotide
tttgaagggtgatgggtactg

SEQ ID NO: 512 - DNA, 20 bp, Artificial Sequence
  Description of Artificial Sequence: Synthetic oligonucleotide
agtaacctgttgaactgcac

SEQ ID NO: 513 - DNA, 20 bp, Artificial Sequence
  Description of Artificial Sequence: Synthetic oligonucleotide
tttgaagggtggcgggtccg

SEQ ID NO: 514 - DNA, 19 bp, Artificial Sequence
  Description of Artificial Sequence: Synthetic oligonucleotide
ttgggtgtagggtggtgcg

SEQ ID NO: 515 - DNA, 20 bp, Artificial Sequence
  Description of Artificial Sequence: Synthetic oligonucleotide
tttggtggagggtgggaccg

SEQ ID NO: 516 - DNA, 20 bp, Artificial Sequence
  Description of Artificial Sequence: Synthetic oligonucleotide
tcctaggttgtcttattctg

SEQ ID NO: 517 - DNA, 20 bp, Artificial Sequence
  Description of Artificial Sequence: Synthetic oligonucleotide
gtcctctggcttatcgtccc

SEQ ID NO: 518 - DNA, 21 bp, Artificial Sequence
  Description of Artificial Sequence: Synthetic oligonucleotide
tttgaagggtgatgggttccg

SEQ ID NO: 519 - DNA, 20 bp, Artificial Sequence
  Description of Artificial Sequence: Synthetic oligonucleotide
tttggaggaggatgggaccg

SEQ ID NO: 520 - DNA, 20 bp, Artificial Sequence
  Description of Artificial Sequence: Synthetic oligonucleotide
tttggggtcttcccgtgccc

SEQ ID NO: 521 - DNA, 20 bp, Artificial Sequence
  Description of Artificial Sequence: Synthetic oligonucleotide
tcctgtcgtctgttcgcccc

SEQ ID NO: 522 - DNA, 20 bp, Artificial Sequence
  Description of Artificial Sequence: Synthetic oligonucleotide
attggtcaagggaggtactg

SEQ ID NO: 523 - DNA, 20 bp, Artificial Sequence
  Description of Artificial Sequence: Synthetic oligonucleotide
tttgaagggtgatgggtctt

SEQ ID NO: 524 - DNA, 20 bp, Artificial Sequence
  Description of Artificial Sequence: Synthetic oligonucleotide
cgttttatactgcaagtgcc

SEQ ID NO: 525 - DNA, 18 bp, Artificial Sequence
  Description of Artificial Sequence: Synthetic oligonucleotide
ttgggtgtagggtggtac

SEQ ID NO: 526 - DNA, 20 bp, Artificial Sequence
  Description of Artificial Sequence: Synthetic oligonucleotide
tgtgggaggaggaggtaccg

SEQ ID NO: 527 - DNA, 20 bp, Artificial Sequence
  Description of Artificial Sequence: Synthetic oligonucleotide
ttgggggtagggcggtaccg

SEQ ID NO: 528 - DNA, 20 bp, Artificial Sequence
  Description of Artificial Sequence: Synthetic oligonucleotide
tttggagtagggtgggaccg

SEQ ID NO: 529 - DNA, 20 bp, Artificial Sequence
  Description of Artificial Sequence: Synthetic oligonucleotide
tcctgtcgtctgtttgtccc

SEQ ID NO: 530 - DNA, 20 bp, Artificial Sequence
  Description of Artificial Sequence: Synthetic oligonucleotide
ttcgaagggtggtgggtccg

SEQ ID NO: 531 - DNA, 20 bp, Artificial Sequence
  Description of Artificial Sequence: Synthetic oligonucleotide
ttgggagtagggcggtaccg

SEQ ID NO: 532 - DNA, 20 bp, Artificial Sequence
  Description of Artificial Sequence: Synthetic oligonucleotide
tttggagggtgatgggaccg

SEQ ID NO: 533 - DNA, 20 bp, Artificial Sequence
  Description of Artificial Sequence: Synthetic oligonucleotide
tcctgccgtctgttcgtccc

SEQ ID NO: 534 - DNA, 20 bp, Artificial Sequence
  Description of Artificial Sequence: Synthetic oligonucleotide
attggtgaaaggaggtaccg

SEQ ID NO: 535 - DNA, 21 bp, Artificial Sequence
  Description of Artificial Sequence: Synthetic oligonucleotide
tgactcgtctgttttcgtccc

SEQ ID NO: 536 - DNA, 20 bp, Artificial Sequence
  Description of Artificial Sequence: Synthetic oligonucleotide
tttgaaggaggatgggaccg

SEQ ID NO: 537 - DNA, 20 bp, Artificial Sequence
  Description of Artificial Sequence: Synthetic oligonucleotide
ttgcgtgtagggtggtaccg

SEQ ID NO: 538 - DNA, 20 bp, Artificial Sequence
  Description of Artificial Sequence: Synthetic oligonucleotide
ttgggtgtagcgtggtaccg

SEQ ID NO: 539 - DNA, 20 bp, Artificial Sequence
  Description of Artificial Sequence: Synthetic oligonucleotide
tttgaagggggatggggccg

SEQ ID NO: 540 - DNA, 20 bp, Artificial Sequence
  Description of Artificial Sequence: Synthetic oligonucleotide
ctaagaaagggaggtggtgc

SEQ ID NO: 541 - DNA, 20 bp, Artificial Sequence
  Description of Artificial Sequence: Synthetic oligonucleotide
ttctgtcgtctgttcgtccc

SEQ ID NO: 542 - DNA, 20 bp, Artificial Sequence
  Description of Artificial Sequence: Synthetic oligonucleotide
tcctgtcgtcttttcgtccc

SEQ ID NO: 543 - DNA, 20 bp, Artificial Sequence
  Description of Artificial Sequence: Synthetic oligonucleotide
tggaggaggaggaggtaccg

SEQ ID NO: 544 - DNA, 20 bp, Artificial Sequence
  Description of Artificial Sequence: Synthetic oligonucleotide
tgtagaaggaggaggtaccg

SEQ ID NO: 545 - DNA, 20 bp, Artificial Sequence
  Description of Artificial Sequence: Synthetic oligonucleotide
tattggaggagtagggaccg

SEQ ID NO: 546 - DNA, 20 bp, Artificial Sequence
  Description of Artificial Sequence: Synthetic oligonucleotide
aaacgagccgtcttatcctg

SEQ ID NO: 547 - DNA, 20 bp, Artificial Sequence
  Description of Artificial Sequence: Synthetic oligonucleotide
tttggggctttcccgtgccc

SEQ ID NO: 548 - DNA, 20 bp, Artificial Sequence
  Description of Artificial Sequence: Synthetic oligonucleotide
tcctgtcgtctgttcgtttc

SEQ ID NO: 549 - DNA, 20 bp, Artificial Sequence
  Description of Artificial Sequence: Synthetic oligonucleotide
cgtttcatctggttcgtccc

SEQ ID NO: 550 - DNA, 20 bp, Artificial Sequence
  Description of Artificial Sequence: Synthetic oligonucleotide
gatgaaggcctgtcgtgtac

SEQ ID NO: 551 - DNA, 20 bp, Artificial Sequence
  Description of Artificial Sequence: Synthetic oligonucleotide
caataggaggagtggggcgc

SEQ ID NO: 552 - DNA, 20 bp, Artificial Sequence
  Description of Artificial Sequence: Synthetic oligonucleotide
attggtgaaggcaggtactg

SEQ ID NO: 553 - DNA, 20 bp, Artificial Sequence
  Description of Artificial Sequence: Synthetic oligonucleotide
tgttggaggtgtagggaccg

SEQ ID NO: 554 - DNA, 20 bp, Artificial Sequence
  Description of Artificial Sequence: Synthetic oligonucleotide
cttgaagggtggtgggtccg

SEQ ID NO: 555 - DNA, 20 bp, Artificial Sequence
  Description of Artificial Sequence: Synthetic oligonucleotide
tttgaagggagctgggtccg

SEQ ID NO: 556 - DNA, 20 bp, Artificial Sequence
  Description of Artificial Sequence: Synthetic oligonucleotide
gcctttcgttgtgccctccc

SEQ ID NO: 557 - DNA, 20 bp, Artificial Sequence
  Description of Artificial Sequence: Synthetic oligonucleotide
gcctttcgttcagacctccc

SEQ ID NO: 558 - DNA, 20 bp, Artificial Sequence
  Description of Artificial Sequence: Synthetic oligonucleotide
gcctttcgttctgacctttc

SEQ ID NO: 559 - DNA, 20 bp, Artificial Sequence
  Description of Artificial Sequence: Synthetic oligonucleotide
gcctttcgttttgacctccc

SEQ ID NO: 560 - DNA, 20 bp, Artificial Sequence
  Description of Artificial Sequence: Synthetic oligonucleotide
attggggaagggaggtaccg

SEQ ID NO: 561 - DNA, 20 bp, Artificial Sequence
  Description of Artificial Sequence: Synthetic oligonucleotide
tgcaggaggaggaggtaccg

SEQ ID NO: 562 - DNA, 20 bp, Artificial Sequence
  Description of Artificial Sequence: Synthetic oligonucleotide
gcctttggttctgccctccc

SEQ ID NO: 563 - DNA, 19 bp, Artificial Sequence
  Description of Artificial Sequence: Synthetic oligonucleotide
attgggaagggaggtactg

SEQ ID NO: 564 - DNA, 20 bp, Artificial Sequence
  Description of Artificial Sequence: Synthetic oligonucleotide
atagggaggagggtgaaccg

SEQ ID NO: 565 - DNA, 21 bp, Artificial Sequence
  Description of Artificial Sequence: Synthetic oligonucleotide
tttgaagggtgatagggtccg

SEQ ID NO: 566 - DNA, 19 bp, Artificial Sequence
  Description of Artificial Sequence: Synthetic oligonucleotide
ttgggttagggtggtaccg

SEQ ID NO: 567 - DNA, 20 bp, Artificial Sequence
  Description of Artificial Sequence: Synthetic oligonucleotide
tttgaagggcgctgggtccg

SEQ ID NO: 568 - DNA, 20 bp, Artificial Sequence
  Description of Artificial Sequence: Synthetic oligonucleotide
cttgaagggagatgggtccg

SEQ ID NO: 569 - DNA, 19 bp, Artificial Sequence
  Description of Artificial Sequence: Synthetic oligonucleotide
ttggtgaagggaggtactg

SEQ ID NO: 570 - DNA, 20 bp, Artificial Sequence
  Description of Artificial Sequence: Synthetic oligonucleotide
tttgaagggagatgggaccg

SEQ ID NO: 571 - DNA, 21 bp, Artificial Sequence
  Description of Artificial Sequence: Synthetic oligonucleotide
gccttttcgttctgacctccc

SEQ ID NO: 572 - DNA, 20 bp, Artificial Sequence
  Description of Artificial Sequence: Synthetic oligonucleotide
attcgtgaagggaggtactg

SEQ ID NO: 573 - DNA, 20 bp, Artificial Sequence
  Description of Artificial Sequence: Synthetic oligonucleotide
ttgggtgtagggtcgtaccg

SEQ ID NO: 574 - DNA, 20 bp, Artificial Sequence
  Description of Artificial Sequence: Synthetic oligonucleotide
tgaaggaggaggaggtaccg

SEQ ID NO: 575 - DNA, 22 bp, Artificial Sequence
  Description of Artificial Sequence: Synthetic oligonucleotide
tttttgaagggtgatgggtccg

SEQ ID NO: 576 - DNA, 20 bp, Artificial Sequence
  Description of Artificial Sequence: Synthetic oligonucleotide
catcggttctcatcgttgtg

SEQ ID NO: 577 - DNA, 20 bp, Artificial Sequence
  Description of Artificial Sequence: Synthetic oligonucleotide
ctgaggagaagggaggttgc

SEQ ID NO: 578 - DNA, 18 bp, Artificial Sequence
  Description of Artificial Sequence: Synthetic oligonucleotide
tcctgtcgtctgttcgtc

SEQ ID NO: 579 - DNA, 20 bp, Artificial Sequence
  Description of Artificial Sequence: Synthetic oligonucleotide
tgtaggaggagaaggtaccg

SEQ ID NO: 580 - DNA, 20 bp, Artificial Sequence
  Description of Artificial Sequence: Synthetic oligonucleotide
atgggtgaagggaggtaccg

SEQ ID NO: 581 - DNA, 20 bp, Artificial Sequence
  Description of Artificial Sequence: Synthetic oligonucleotide
tcctgtcgtctgttcatccc

SEQ ID NO: 582 - DNA, 20 bp, Artificial Sequence
  Description of Artificial Sequence: Synthetic oligonucleotide
gcctttcgttctcacctccc

SEQ ID NO: 583 - DNA, 20 bp, Artificial Sequence
  Description of Artificial Sequence: Synthetic oligonucleotide
tttgaagggcgatgggcccg

SEQ ID NO: 584 - DNA, 20 bp, Artificial Sequence
  Description of Artificial Sequence: Synthetic oligonucleotide
attggtgaagagaggtaccg

SEQ ID NO: 585 - DNA, 20 bp, Artificial Sequence
  Description of Artificial Sequence: Synthetic oligonucleotide
ttggaagggggatgggtccg

SEQ ID NO: 586 - DNA, 20 bp, Artificial Sequence
  Description of Artificial Sequence: Synthetic oligonucleotide
tttggaggggggtgggtccg

SEQ ID NO: 587 - DNA, 20 bp, Artificial Sequence
  Description of Artificial Sequence: Synthetic oligonucleotide
ttgggcgtagggcggtaccg

SEQ ID NO: 588 - DNA, 20 bp, Artificial Sequence
  Description of Artificial Sequence: Synthetic oligonucleotide
tttgaagggagatgggcccg

SEQ ID NO: 589 - DNA, 20 bp, Artificial Sequence
  Description of Artificial Sequence: Synthetic oligonucleotide
tttgaagggtggagggtccg

SEQ ID NO: 590 - DNA, 20 bp, Artificial Sequence
  Description of Artificial Sequence: Synthetic oligonucleotide
tttgcagggagatgggtccg

SEQ ID NO: 591 - DNA, 20 bp, Artificial Sequence
  Description of Artificial Sequence: Synthetic oligonucleotide
tagaggagaagggaggttgc

SEQ ID NO: 592 - DNA, 18 bp, Artificial Sequence
  Description of Artificial Sequence: Synthetic oligonucleotide
gcctttcgttctgccccc

SEQ ID NO: 593 - DNA, 21 bp, Artificial Sequence
  Description of Artificial Sequence: Synthetic oligonucleotide
gtgttcgtctgttttcgtccc

SEQ ID NO: 594 - DNA, 21 bp, Artificial Sequence
  Description of Artificial Sequence: Synthetic oligonucleotide
tttgaagggtgatgggtacct

SEQ ID NO: 595 - DNA, 20 bp, Artificial Sequence
  Description of Artificial Sequence: Synthetic oligonucleotide
cagaggagaggggaggttgc

SEQ ID NO: 596 - DNA, 20 bp, Artificial Sequence
  Description of Artificial Sequence: Synthetic oligonucleotide
gcctttcgttctgaccaccc

SEQ ID NO: 597 - DNA, 20 bp, Artificial Sequence
  Description of Artificial Sequence: Synthetic oligonucleotide
attagtgaagggaggtaccg

SEQ ID NO: 598 - DNA, 19 bp, Artificial Sequence
  Description of Artificial Sequence: Synthetic oligonucleotide
gcctttgttctgacctccc

SEQ ID NO: 599 - DNA, 20 bp, Artificial Sequence
  Description of Artificial Sequence: Synthetic oligonucleotide
gtagggagaagggtgaaccg

SEQ ID NO: 600 - DNA, 20 bp, Artificial Sequence
  Description of Artificial Sequence: Synthetic oligonucleotide
tattgggggtgtagggaccg

SEQ ID NO: 601 - DNA, 20 bp, Artificial Sequence
  Description of Artificial Sequence: Synthetic oligonucleotide
attggtgaagggaggtagtg

SEQ ID NO: 602 - DNA, 20 bp, Artificial Sequence
  Description of Artificial Sequence: Synthetic oligonucleotide
ttgggagtagggaggtaccg

SEQ ID NO: 603 - DNA, 19 bp, Artificial Sequence
  Description of Artificial Sequence: Synthetic oligonucleotide
tcctgtcgtcttgcgtccc

SEQ ID NO: 604 - DNA, 20 bp, Artificial Sequence
  Description of Artificial Sequence: Synthetic oligonucleotide
atagggaggaggtgaatgtg

SEQ ID NO: 605 - DNA, 19 bp, Artificial Sequence
  Description of Artificial Sequence: Synthetic oligonucleotide
ttgggtgtagggtgaaccg

SEQ ID NO: 606 - DNA, 20 bp, Artificial Sequence
  Description of Artificial Sequence: Synthetic oligonucleotide
tgttggaggaggaggtaccg

SEQ ID NO: 607 - DNA, 20 bp, Artificial Sequence
  Description of Artificial Sequence: Synthetic oligonucleotide
gcctttctttctgacctccc

SEQ ID NO: 608 - DNA, 20 bp, Artificial Sequence
  Description of Artificial Sequence: Synthetic oligonucleotide
attggtgaagcgaggtactg

SEQ ID NO: 609 - DNA, 21 bp, Artificial Sequence
  Description of Artificial Sequence: Synthetic oligonucleotide
tttgaaagggtgatgggtccg

SEQ ID NO: 610 - DNA, 20 bp, Artificial Sequence
  Description of Artificial Sequence: Synthetic oligonucleotide
gatgacggcggtgtcgctac

SEQ ID NO: 611 - DNA, 20 bp, Artificial Sequence
  Description of Artificial Sequence: Synthetic oligonucleotide
gccgttcgttctgccctccc

SEQ ID NO: 612 - DNA, 20 bp, Artificial Sequence
  Description of Artificial Sequence: Synthetic oligonucleotide
attgctgaagggaggtactg

SEQ ID NO: 613 - DNA, 20 bp, Artificial Sequence
  Description of Artificial Sequence: Synthetic oligonucleotide
ttgggtgtagggcgttaccg

SEQ ID NO: 614 - DNA, 20 bp, Artificial Sequence
  Description of Artificial Sequence: Synthetic oligonucleotide
tttgaagggggatgggcccg

SEQ ID NO: 615 - DNA, 20 bp, Artificial Sequence
  Description of Artificial Sequence: Synthetic oligonucleotide
tttgacgggcgatgggtccg

SEQ ID NO: 616 - DNA, 20 bp, Artificial Sequence
  Description of Artificial Sequence: Synthetic oligonucleotide
tttgacgggagatgggtccg

SEQ ID NO: 617 - DNA, 20 bp, Artificial Sequence
  Description of Artificial Sequence: Synthetic oligonucleotide
tcctatcgtctgttcgtccc

SEQ ID NO: 618 - DNA, 20 bp, Artificial Sequence
  Description of Artificial Sequence: Synthetic oligonucleotide
gcgtttcgttctgccctccc

SEQ ID NO: 619 - DNA, 18 bp, Artificial Sequence
  Description of Artificial Sequence: Synthetic oligonucleotide
tttgaggtgatgggtccg

SEQ ID NO: 620 - DNA, 19 bp, Artificial Sequence
  Description of Artificial Sequence: Synthetic oligonucleotide
tttgaagggtgagggtccg

SEQ ID NO: 621 - DNA, 20 bp, Artificial Sequence
  Description of Artificial Sequence: Synthetic oligonucleotide
tttgaagggggatgggtctg

SEQ ID NO: 622 - DNA, 20 bp, Artificial Sequence
  Description of Artificial Sequence: Synthetic oligonucleotide
tttgaagggggatggttccg

SEQ ID NO: 623 - DNA, 20 bp, Artificial Sequence
  Description of Artificial Sequence: Synthetic oligonucleotide
tttgaagggggttgggtccg

SEQ ID NO: 624 - DNA, 20 bp, Artificial Sequence
  Description of Artificial Sequence: Synthetic oligonucleotide
agttggaggagggaggtctg

SEQ ID NO: 625 - DNA, 20 bp, Artificial Sequence
  Description of Artificial Sequence: Synthetic oligonucleotide
tcctgtcgtctgttcgtcca

SEQ ID NO: 626 - DNA, 20 bp, Artificial Sequence
  Description of Artificial Sequence: Synthetic oligonucleotide
attggtgatgggaggtaccg

SEQ ID NO: 627 - DNA, 20 bp, Artificial Sequence
  Description of Artificial Sequence: Synthetic oligonucleotide
tttggagggtggtgggtccg

SEQ ID NO: 628 - DNA, 20 bp, Artificial Sequence
  Description of Artificial Sequence: Synthetic oligonucleotide
tttggtgtagggtgggaccg

SEQ ID NO: 629 - DNA, 20 bp, Artificial Sequence
  Description of Artificial Sequence: Synthetic oligonucleotide
tcctgtcgtctgttcgtctc

SEQ ID NO: 630 - DNA, 20 bp, Artificial Sequence
  Description of Artificial Sequence: Synthetic oligonucleotide
cgactatgtcgtcttgcccc

SEQ ID NO: 631 - DNA, 20 bp, Artificial Sequence
  Description of Artificial Sequence: Synthetic oligonucleotide
cggaggagaagggaggttgc

SEQ ID NO: 632 - DNA, 20 bp, Artificial Sequence
  Description of Artificial Sequence: Synthetic oligonucleotide
gcctttcgttctgaactccc

SEQ ID NO: 633 - DNA, 19 bp, Artificial Sequence
  Description of Artificial Sequence: Synthetic oligonucleotide
tttggggttttccctgccc

SEQ ID NO: 634 - DNA, 20 bp, Artificial Sequence
  Description of Artificial Sequence: Synthetic oligonucleotide
attgatgaagggaggtaccg

SEQ ID NO: 635 - DNA, 20 bp, Artificial Sequence
  Description of Artificial Sequence: Synthetic oligonucleotide
ttgggcgtagggaggtaccg

SEQ ID NO: 636 - DNA, 21 bp, Artificial Sequence
  Description of Artificial Sequence: Synthetic oligonucleotide
ttttgaagggtgatgggtccc

SEQ ID NO: 637 - DNA, 20 bp, Artificial Sequence
  Description of Artificial Sequence: Synthetic oligonucleotide
ttgggaggggggtgggaccg

SEQ ID NO: 638 - DNA, 20 bp, Artificial Sequence
  Description of Artificial Sequence: Synthetic oligonucleotide
tttgaagggagatggggccg

SEQ ID NO: 639 - DNA, 20 bp, Artificial Sequence
  Description of Artificial Sequence: Synthetic oligonucleotide
tttgaagtcgtcttatcctg

SEQ ID NO: 640 - DNA, 20 bp, Artificial Sequence
  Description of Artificial Sequence: Synthetic oligonucleotide
gcctttcgtactgccctccc

SEQ ID NO: 641 - DNA, 19 bp, Artificial Sequence
  Description of Artificial Sequence: Synthetic oligonucleotide
tgactcgtctgttcgtccc

SEQ ID NO: 642 - DNA, 20 bp, Artificial Sequence
  Description of Artificial Sequence: Synthetic oligonucleotide
attggtgaaggaaggtaccg

SEQ ID NO: 643 - DNA, 20 bp, Artificial Sequence
  Description of Artificial Sequence: Synthetic oligonucleotide
tcctgtcgtttgttcgtccc

SEQ ID NO: 644 - DNA, 19 bp, Artificial Sequence
  Description of Artificial Sequence: Synthetic oligonucleotide
gcctttcgtctaccctccc

SEQ ID NO: 645 - DNA, 19 bp, Artificial Sequence
  Description of Artificial Sequence: Synthetic oligonucleotide
cggaaaggtggaggtggtg

SEQ ID NO: 646 - DNA, 20 bp, Artificial Sequence
  Description of Artificial Sequence: Synthetic oligonucleotide
tttggtggagggtggtaccg

SEQ ID NO: 647 - DNA, 20 bp, Artificial Sequence
  Description of Artificial Sequence: Synthetic oligonucleotide
tttgaagaatgatgggtccg

SEQ ID NO: 648 - DNA, 20 bp, Artificial Sequence
  Description of Artificial Sequence: Synthetic oligonucleotide
tttgaaggagggtgggaccg

SEQ ID NO: 649 - DNA, 20 bp, Artificial Sequence
  Description of Artificial Sequence: Synthetic oligonucleotide
attggtgaagggtgggactg

SEQ ID NO: 650 - DNA, 20 bp, Artificial Sequence
  Description of Artificial Sequence: Synthetic oligonucleotide
gttgaagggtggtgggtccg

SEQ ID NO: 651 - DNA, 20 bp, Artificial Sequence
  Description of Artificial Sequence: Synthetic oligonucleotide
ctttttactctttttttccg

SEQ ID NO: 652 - DNA, 20 bp, Artificial Sequence
  Description of Artificial Sequence: Synthetic oligonucleotide
cagaggagaaggaaggttgc

SEQ ID NO: 653 - DNA, 19 bp, Artificial Sequence
  Description of Artificial Sequence: Synthetic oligonucleotide
gcctttcttctgccctccc

SEQ ID NO: 654 - DNA, 20 bp, Artificial Sequence
  Description of Artificial Sequence: Synthetic oligonucleotide
cagaggagaagggaggttgt

SEQ ID NO: 655 - DNA, 19 bp, Artificial Sequence
  Description of Artificial Sequence: Synthetic oligonucleotide
gcctttcgttctgcccttc

SEQ ID NO: 656 - DNA, 20 bp, Artificial Sequence
  Description of Artificial Sequence: Synthetic oligonucleotide
ttagggtgtagggtggtccg

SEQ ID NO: 657 - DNA, 20 bp, Artificial Sequence
  Description of Artificial Sequence: Synthetic oligonucleotide
tgtttcgctctccccgtctg

SEQ ID NO: 658 - DNA, 20 bp, Artificial Sequence
  Description of Artificial Sequence: Synthetic oligonucleotide
tgactcgtctgtctcgtccc

SEQ ID NO: 659 - DNA, 20 bp, Artificial Sequence
  Description of Artificial Sequence: Synthetic oligonucleotide
tattggaggtgtggggaccg

SEQ ID NO: 660 - DNA, 18 bp, Artificial Sequence
  Description of Artificial Sequence: Synthetic oligonucleotide
cgaagggtgatgggtccg

SEQ ID NO: 661 - DNA, 19 bp, Artificial Sequence
  Description of Artificial Sequence: Synthetic oligonucleotide
ttgaagggtggtgggtccg

SEQ ID NO: 662 - DNA, 18 bp, Artificial Sequence
  Description of Artificial Sequence: Synthetic oligonucleotide
tttagggtgatgggtccg

SEQ ID NO: 663 - DNA, 19 bp, Artificial Sequence
  Description of Artificial Sequence: Synthetic oligonucleotide
ttgggtgtagggggtaccg

SEQ ID NO: 664 - DNA, 20 bp, Artificial Sequence
  Description of Artificial Sequence: Synthetic oligonucleotide
tttgaaggaggatgggtccg

SEQ ID NO: 665 - DNA, 20 bp, Artificial Sequence
  Description of Artificial Sequence: Synthetic oligonucleotide
tttgaagggtggggggtccg

SEQ ID NO: 666 - DNA, 22 bp, Artificial Sequence
  Description of Artificial Sequence: Synthetic oligonucleotide
tgtttgaagggtgatgggtccg

SEQ ID NO: 667 - DNA, 20 bp, Artificial Sequence
  Description of Artificial Sequence: Synthetic oligonucleotide
gttgaagggggatgggtccg

SEQ ID NO: 668 - DNA, 20 bp, Artificial Sequence
  Description of Artificial Sequence: Synthetic oligonucleotide
cagaggagtagggaggttgc

SEQ ID NO: 669 - DNA, 20 bp, Artificial Sequence
  Description of Artificial Sequence: Synthetic oligonucleotide
aggcggctcgtcttatactg

SEQ ID NO: 670 - DNA, 18 bp, Artificial Sequence
  Description of Artificial Sequence: Synthetic oligonucleotide
cttgtcgtcttgcgtccc

SEQ ID NO: 671 - DNA, 21 bp, Artificial Sequence
  Description of Artificial Sequence: Synthetic oligonucleotide
gtcctgtcgtctgttcgtcct

SEQ ID NO: 672 - DNA, 20 bp, Artificial Sequence
  Description of Artificial Sequence: Synthetic oligonucleotide
tttgaggggtggtgggtccg

SEQ ID NO: 673 - DNA, 20 bp, Artificial Sequence
  Description of Artificial Sequence: Synthetic oligonucleotide
attggtgaagtgaggtaccg

SEQ ID NO: 674 - DNA, 20 bp, Artificial Sequence
  Description of Artificial Sequence: Synthetic oligonucleotide
tctgaagggtggtgggtccg

SEQ ID NO: 675 - DNA, 20 bp, Artificial Sequence
  Description of Artificial Sequence: Synthetic oligonucleotide
tattggaggggtagggaccg

SEQ ID NO: 676 - DNA, 19 bp, Artificial Sequence
  Description of Artificial Sequence: Synthetic oligonucleotide
gatgacggcgagtgtgcac

SEQ ID NO: 677 - DNA, 20 bp, Artificial Sequence
  Description of Artificial Sequence: Synthetic oligonucleotide
gctcttcgttctgccctccc

SEQ ID NO: 678 - DNA, 19 bp, Artificial Sequence
  Description of Artificial Sequence: Synthetic oligonucleotide
ttggggttttcccgtgccc

SEQ ID NO: 679 - DNA, 20 bp, Artificial Sequence
  Description of Artificial Sequence: Synthetic oligonucleotide
gcctatcgttctgacctccc

SEQ ID NO: 680 - DNA, 20 bp, Artificial Sequence
  Description of Artificial Sequence: Synthetic oligonucleotide
ggtagggatggaggtgttcg

SEQ ID NO: 681 - DNA, 20 bp, Artificial Sequence
  Description of Artificial Sequence: Synthetic oligonucleotide
attggtggagggagggactg

SEQ ID NO: 682 - DNA, 20 bp, Artificial Sequence
  Description of Artificial Sequence: Synthetic oligonucleotide
tttggtgaagggagggactg

SEQ ID NO: 683 - DNA, 19 bp, Artificial Sequence
  Description of Artificial Sequence: Synthetic oligonucleotide
attggtgagggaggtactg

SEQ ID NO: 684 - DNA, 20 bp, Artificial Sequence
  Description of Artificial Sequence: Synthetic oligonucleotide
atagggagaagggggaaccg

SEQ ID NO: 685 - DNA, 21 bp, Artificial Sequence
  Description of Artificial Sequence: Synthetic oligonucleotide
tattgaagggtgatgggtccg

SEQ ID NO: 686 - DNA, 20 bp, Artificial Sequence
  Description of Artificial Sequence: Synthetic oligonucleotide
tttggagggcgatgggtccg

SEQ ID NO: 687 - DNA, 20 bp, Artificial Sequence
  Description of Artificial Sequence: Synthetic oligonucleotide
gcctttcgttctgacctcgc

SEQ ID NO: 688 - DNA, 20 bp, Artificial Sequence
  Description of Artificial Sequence: Synthetic oligonucleotide
tttggggttttcccgtgtcc

SEQ ID NO: 689 - DNA, 20 bp, Artificial Sequence
  Description of Artificial Sequence: Synthetic oligonucleotide
tcctgtcgtctgtccgtccc

SEQ ID NO: 690 - DNA, 20 bp, Artificial Sequence
  Description of Artificial Sequence: Synthetic oligonucleotide
tctttcctgtcgtactggtg

SEQ ID NO: 691 - DNA, 20 bp, Artificial Sequence
  Description of Artificial Sequence: Synthetic oligonucleotide
cctccagacctgtttctgtc

SEQ ID NO: 692 - DNA, 20 bp, Artificial Sequence
  Description of Artificial Sequence: Synthetic oligonucleotide
tgaaagttctcgtcggcccc

SEQ ID NO: 693 - DNA, 20 bp, Artificial Sequence
  Description of Artificial Sequence: Synthetic oligonucleotide
gcctgtcgttctgccctccc

SEQ ID NO: 694 - DNA, 20 bp, Artificial Sequence
  Description of Artificial Sequence: Synthetic oligonucleotide
tttgaagggtggtgtgtccg

SEQ ID NO: 695 - DNA, 20 bp, Artificial Sequence
  Description of Artificial Sequence: Synthetic oligonucleotide
tttgaagggtagtgggtccg

SEQ ID NO: 696 - DNA, 20 bp, Artificial Sequence
  Description of Artificial Sequence: Synthetic oligonucleotide
ttgggtgtagggggttaccg

SEQ ID NO: 697 - DNA, 19 bp, Artificial Sequence
  Description of Artificial Sequence: Synthetic oligonucleotide
tttgaagggtgtgggtccg

SEQ ID NO: 698 - DNA, 20 bp, Artificial Sequence
  Description of Artificial Sequence: Synthetic oligonucleotide
tttgaaggtggatgggtccg

SEQ ID NO: 699 - DNA, 20 bp, Artificial Sequence
  Description of Artificial Sequence: Synthetic oligonucleotide
gacagtcgtcacttcctgcc

SEQ ID NO: 700 - DNA, 20 bp, Artificial Sequence
  Description of Artificial Sequence: Synthetic oligonucleotide
tttggggttttcctgtgccc

SEQ ID NO: 701 - DNA, 20 bp, Artificial Sequence
  Description of Artificial Sequence: Synthetic oligonucleotide
attggtgaagggaggtacca

SEQ ID NO: 702 - DNA, 20 bp, Artificial Sequence
  Description of Artificial Sequence: Synthetic oligonucleotide
acctcctcgagttgtgtcgc

SEQ ID NO: 703 - DNA, 20 bp, Artificial Sequence
  Description of Artificial Sequence: Synthetic oligonucleotide
tggacgaccgtctgtatgtg

SEQ ID NO: 704 - DNA, 20 bp, Artificial Sequence
  Description of Artificial Sequence: Synthetic oligonucleotide
gtcctgtcgtctgttcgtcc

SEQ ID NO: 705 - DNA, 20 bp, Artificial Sequence
  Description of Artificial Sequence: Synthetic oligonucleotide
tctcctgtggcgttgtgctg

SEQ ID NO: 706 - DNA, 20 bp, Artificial Sequence
  Description of Artificial Sequence: Synthetic oligonucleotide
ttgggtgtaggggggcaccg

SEQ ID NO: 707 - DNA, 21 bp, Artificial Sequence
  Description of Artificial Sequence: Synthetic oligonucleotide
gtttgaagggtgatgggtccg

SEQ ID NO: 708 - DNA, 20 bp, Artificial Sequence
  Description of Artificial Sequence: Synthetic oligonucleotide
tttgaagggcgatgggaccg

SEQ ID NO: 709 - DNA, 20 bp, Artificial Sequence
  Description of Artificial Sequence: Synthetic oligonucleotide
tttgatgggggatgggtccg

SEQ ID NO: 710 - DNA, 20 bp, Artificial Sequence
  Description of Artificial Sequence: Synthetic oligonucleotide
cagaggagatgggaggttgc

SEQ ID NO: 711 - DNA, 20 bp, Artificial Sequence
  Description of Artificial Sequence: Synthetic oligonucleotide
atagggagaagggtgtaccg

SEQ ID NO: 712 - DNA, 20 bp, Artificial Sequence
  Description of Artificial Sequence: Synthetic oligonucleotide
tgactcgtttgtatcttccc

SEQ ID NO: 713 - DNA, 20 bp, Artificial Sequence
  Description of Artificial Sequence: Synthetic oligonucleotide
taatcgtttcctcctgtgtc

SEQ ID NO: 714 - DNA, 20 bp, Artificial Sequence
  Description of Artificial Sequence: Synthetic oligonucleotide
tgtaggaggaggaagtaccg

SEQ ID NO: 715 - DNA, 20 bp, Artificial Sequence
  Description of Artificial Sequence: Synthetic oligonucleotide
agtgggagaagggtgttacg

SEQ ID NO: 716 - DNA, 21 bp, Artificial Sequence
  Description of Artificial Sequence: Synthetic oligonucleotide
gttgggtgtagggtggtaccg

SEQ ID NO: 717 - DNA, 20 bp, Artificial Sequence
  Description of Artificial Sequence: Synthetic oligonucleotide
tttgaagggtgatgaatccg

SEQ ID NO: 718 - DNA, 20 bp, Artificial Sequence
  Description of Artificial Sequence: Synthetic oligonucleotide
gcctttcgttctgctttccc

SEQ ID NO: 719 - DNA, 20 bp, Artificial Sequence
  Description of Artificial Sequence: Synthetic oligonucleotide
ttgggggtagggaggtaccg

SEQ ID NO: 720 - DNA, 20 bp, Artificial Sequence
  Description of Artificial Sequence: Synthetic oligonucleotide
tttggaggagggtggtaccg

SEQ ID NO: 721 - DNA, 20 bp, Artificial Sequence
  Description of Artificial Sequence: Synthetic oligonucleotide
caaaggagaagggaggttgc

SEQ ID NO: 722 - DNA, 20 bp, Artificial Sequence
  Description of Artificial Sequence: Synthetic oligonucleotide
cagaggagaagagaggttgc

SEQ ID NO: 723 - DNA, 20 bp, Artificial Sequence
  Description of Artificial Sequence: Synthetic oligonucleotide
tgggtgaagggtgtatagcg

SEQ ID NO: 724 - DNA, 20 bp, Artificial Sequence
  Description of Artificial Sequence: Synthetic oligonucleotide
tttgaagggtggtggtaccg

SEQ ID NO: 725 - DNA, 20 bp, Artificial Sequence
  Description of Artificial Sequence: Synthetic oligonucleotide
tcatctttctcccatgtggc

SEQ ID NO: 726 - DNA, 20 bp, Artificial Sequence
  Description of Artificial Sequence: Synthetic oligonucleotide
tcgatcgttttccgcgtgtg

SEQ ID NO: 727 - DNA, 21 bp, Artificial Sequence
  Description of Artificial Sequence: Synthetic oligonucleotide
gcctttcgttctgcccctccc

SEQ ID NO: 728 - DNA, 20 bp, Artificial Sequence
  Description of Artificial Sequence: Synthetic oligonucleotide
tcctgacgtctgttcgtccc

SEQ ID NO: 729 - DNA, 20 bp, Artificial Sequence
  Description of Artificial Sequence: Synthetic oligonucleotide
ttgggtgtagggcggtactg

SEQ ID NO: 730 - DNA, 20 bp, Artificial Sequence
  Description of Artificial Sequence: Synthetic oligonucleotide
ttgggagggggatgggaccg

SEQ ID NO: 731 - DNA, 20 bp, Artificial Sequence
  Description of Artificial Sequence: Synthetic oligonucleotide
ttgggtgtagggcggcaccg

SEQ ID NO: 732 - DNA, 20 bp, Artificial Sequence
  Description of Artificial Sequence: Synthetic oligonucleotide
tttgaagggagttgggtccg

SEQ ID NO: 733 - DNA, 20 bp, Artificial Sequence
  Description of Artificial Sequence: Synthetic oligonucleotide
ttggaagggggatgggaccg

SEQ ID NO: 734 - DNA, 20 bp, Artificial Sequence
  Description of Artificial Sequence: Synthetic oligonucleotide
tttgcagggggatgggtccg

SEQ ID NO: 735 - DNA, 19 bp, Artificial Sequence
  Description of Artificial Sequence: Synthetic oligonucleotide
tatggaggtgtagggaccg

SEQ ID NO: 736 - DNA, 20 bp, Artificial Sequence
  Description of Artificial Sequence: Synthetic oligonucleotide
tttgtagggcgatgggtccg

SEQ ID NO: 737 - DNA, 20 bp, Artificial Sequence
  Description of Artificial Sequence: Synthetic oligonucleotide
gccgttcgttctgacctccc

SEQ ID NO: 738 - DNA, 20 bp, Artificial Sequence
  Description of Artificial Sequence: Synthetic oligonucleotide
tttggggttttcccctgccc

SEQ ID NO: 739 - DNA, 20 bp, Artificial Sequence
  Description of Artificial Sequence: Synthetic oligonucleotide
tgtaggaggaggaggtaccc

SEQ ID NO: 740 - DNA, 20 bp, Artificial Sequence
  Description of Artificial Sequence: Synthetic oligonucleotide
tgactcgtttgtttcgtccc

SEQ ID NO: 741 - DNA, 18 bp, Artificial Sequence
  Description of Artificial Sequence: Synthetic oligonucleotide
tgtgggtctggttgtggc

SEQ ID NO: 742 - DNA, 18 bp, Artificial Sequence
  Description of Artificial Sequence: Synthetic oligonucleotide
gcctttcgttctgctccc

SEQ ID NO: 743 - DNA, 20 bp, Artificial Sequence
  Description of Artificial Sequence: Synthetic oligonucleotide
gcctttcgttctgacctgcc

SEQ ID NO: 744 - DNA, 20 bp, Artificial Sequence
  Description of Artificial Sequence: Synthetic oligonucleotide
tttgaaggatggtgggtccg

SEQ ID NO: 745 - DNA, 20 bp, Artificial Sequence
  Description of Artificial Sequence: Synthetic oligonucleotide
gttggtgtagggtggtaccg

SEQ ID NO: 746 - DNA, 20 bp, Artificial Sequence
  Description of Artificial Sequence: Synthetic oligonucleotide
gcctttccttctgccctccc

SEQ ID NO: 747 - DNA, 20 bp, Artificial Sequence
  Description of Artificial Sequence: Synthetic oligonucleotide
tgtaggaggaggaggtacca

SEQ ID NO: 748 - DNA, 20 bp, Artificial Sequence
  Description of Artificial Sequence: Synthetic oligonucleotide
ttgggaggaggatgggaccg

SEQ ID NO: 749 - DNA, 18 bp, Artificial Sequence
  Description of Artificial Sequence: Synthetic oligonucleotide
taggaggaggaggtaccg

SEQ ID NO: 750 - DNA, 20 bp, Artificial Sequence
  Description of Artificial Sequence: Synthetic oligonucleotide
tttgaagggcgattggtccg

SEQ ID NO: 751 - DNA, 20 bp, Artificial Sequence
  Description of Artificial Sequence: Synthetic oligonucleotide
tttgaagggcgatggggccg

SEQ ID NO: 752 - DNA, 20 bp, Artificial Sequence
  Description of Artificial Sequence: Synthetic oligonucleotide
cagagaagaagggaggttgc

SEQ ID NO: 753 - DNA, 20 bp, Artificial Sequence
  Description of Artificial Sequence: Synthetic oligonucleotide
agtaggtgaagggtggcccg

SEQ ID NO: 754 - DNA, 20 bp, Artificial Sequence
  Description of Artificial Sequence: Synthetic oligonucleotide
cagaggagaagtgaggttgc

SEQ ID NO: 755 - DNA, 20 bp, Artificial Sequence
  Description of Artificial Sequence: Synthetic oligonucleotide
cagaggagaatggaggttgc

SEQ ID NO: 756 - DNA, 20 bp, Artificial Sequence
  Description of Artificial Sequence: Synthetic oligonucleotide
ctactttatcctgcaagggc

SEQ ID NO: 757 - DNA, 20 bp, Artificial Sequence
  Description of Artificial Sequence: Synthetic oligonucleotide
gcgcatcgttttgactgctg

SEQ ID NO: 758 - DNA, 19 bp, Artificial Sequence
  Description of Artificial Sequence: Synthetic oligonucleotide
ttgggtgtagggtgttccg

SEQ ID NO: 759 - DNA, 20 bp, Artificial Sequence
  Description of Artificial Sequence: Synthetic oligonucleotide
cttggggttttcccgtgccc

SEQ ID NO: 760 - DNA, 20 bp, Artificial Sequence
  Description of Artificial Sequence: Synthetic oligonucleotide
attggtgaatggaggtaccg

SEQ ID NO: 761 - DNA, 20 bp, Artificial Sequence
  Description of Artificial Sequence: Synthetic oligonucleotide
gccattcgttctgacctccc

SEQ ID NO: 762 - DNA, 20 bp, Artificial Sequence
  Description of Artificial Sequence: Synthetic oligonucleotide
tcctgtcatctgttcgtccc

SEQ ID NO: 763 - DNA, 20 bp, Artificial Sequence
  Description of Artificial Sequence: Synthetic oligonucleotide
cattggaggtgtagggaccg

SEQ ID NO: 764 - DNA, 20 bp, Artificial Sequence
  Description of Artificial Sequence: Synthetic oligonucleotide
ggctttcgttctgccctccc

SEQ ID NO: 765 - DNA, 20 bp, Artificial Sequence
  Description of Artificial Sequence: Synthetic oligonucleotide
tttgaagtgggatgggtccg

SEQ ID NO: 766 - DNA, 20 bp, Artificial Sequence
  Description of Artificial Sequence: Synthetic oligonucleotide
tttgaagggtgatgggactg

SEQ ID NO: 767 - DNA, 20 bp, Artificial Sequence
  Description of Artificial Sequence: Synthetic oligonucleotide
tttgaagggggatgggactg

SEQ ID NO: 768 - DNA, 20 bp, Artificial Sequence
  Description of Artificial Sequence: Synthetic oligonucleotide
ggcagtcttctcgatgtgtg

SEQ ID NO: 769 - DNA, 20 bp, Artificial Sequence
  Description of Artificial Sequence: Synthetic oligonucleotide
tgcgtttcgtttgccctgcc

SEQ ID NO: 770 - DNA, 20 bp, Artificial Sequence
  Description of Artificial Sequence: Synthetic oligonucleotide
attggtgaagggaggtaccc

SEQ ID NO: 771 - DNA, 20 bp, Artificial Sequence
  Description of Artificial Sequence: Synthetic oligonucleotide
gatccgtgtcctctggtgtg

SEQ ID NO: 772 - DNA, 21 bp, Artificial Sequence
  Description of Artificial Sequence: Synthetic oligonucleotide
gcctttcgttctgcccttccc

SEQ ID NO: 773 - DNA, 20 bp, Artificial Sequence
  Description of Artificial Sequence: Synthetic oligonucleotide
aactatcatacatatggctg

SEQ ID NO: 774 - DNA, 20 bp, Artificial Sequence
  Description of Artificial Sequence: Synthetic oligonucleotide
cgtttcttctggttcgtccc

SEQ ID NO: 775 - DNA, 20 bp, Artificial Sequence
  Description of Artificial Sequence: Synthetic oligonucleotide
tttgaagggtgatgggggtg

SEQ ID NO: 776 - DNA, 20 bp, Artificial Sequence
  Description of Artificial Sequence: Synthetic oligonucleotide
ttgggcgtaggggggtaccg

SEQ ID NO: 777 - DNA, 20 bp, Artificial Sequence
  Description of Artificial Sequence: Synthetic oligonucleotide
cttgaagggcgatgggtccg

SEQ ID NO: 778 - DNA, 20 bp, Artificial Sequence
  Description of Artificial Sequence: Synthetic oligonucleotide
cagaggaaaagggaggttgc

SEQ ID NO: 779 - DNA, 20 bp, Artificial Sequence
  Description of Artificial Sequence: Synthetic oligonucleotide
gccttctggcttatcgtccc

SEQ ID NO: 780 - DNA, 20 bp, Artificial Sequence
  Description of Artificial Sequence: Synthetic oligonucleotide
tgggccttcgtcttgctgtg

SEQ ID NO: 781 - DNA, 20 bp, Artificial Sequence
  Description of Artificial Sequence: Synthetic oligonucleotide
gcctttcgttgtgacctccc

SEQ ID NO: 782 - DNA, 20 bp, Artificial Sequence
  Description of Artificial Sequence: Synthetic oligonucleotide
tgagtcagtctttaccgccc

SEQ ID NO: 783 - DNA, 19 bp, Artificial Sequence
  Description of Artificial Sequence: Synthetic oligonucleotide
cgtttcctctggttgtccc

SEQ ID NO: 784 - DNA, 20 bp, Artificial Sequence
  Description of Artificial Sequence: Synthetic oligonucleotide
attggtgaagggagctaccg

SEQ ID NO: 785 - DNA, 20 bp, Artificial Sequence
  Description of Artificial Sequence: Synthetic oligonucleotide
ttgattcgtctgtgctcccc

SEQ ID NO: 786 - DNA, 20 bp, Artificial Sequence
  Description of Artificial Sequence: Synthetic oligonucleotide
tgtaggaggaggagctaccg

SEQ ID NO: 787 - DNA, 20 bp, Artificial Sequence
  Description of Artificial Sequence: Synthetic oligonucleotide
cagaggagcagggaggttgc

SEQ ID NO: 788 - DNA, 20 bp, Artificial Sequence
  Description of Artificial Sequence: Synthetic oligonucleotide
attggtgaagggagataccg

SEQ ID NO: 789 - DNA, 20 bp, Artificial Sequence
  Description of Artificial Sequence: Synthetic oligonucleotide
gcctttcgtgctgccctccc

SEQ ID NO: 790 - DNA, 18 bp, Artificial Sequence
  Description of Artificial Sequence: Synthetic oligonucleotide
tttgaagggtgatgggag

SEQ ID NO: 791 - DNA, 20 bp, Artificial Sequence
  Description of Artificial Sequence: Synthetic oligonucleotide
ttgggagtaggggggtaccg

SEQ ID NO: 792 - DNA, 20 bp, Artificial Sequence
  Description of Artificial Sequence: Synthetic oligonucleotide
tttggagggagatgggtccg

SEQ ID NO: 793 - DNA, 20 bp, Artificial Sequence
  Description of Artificial Sequence: Synthetic oligonucleotide
tttgaggggggatgggtccg

SEQ ID NO: 794 - DNA, 20 bp, Artificial Sequence
  Description of Artificial Sequence: Synthetic oligonucleotide
ttaaggaggagatggaggtg

SEQ ID NO: 795 - DNA, 20 bp, Artificial Sequence
  Description of Artificial Sequence: Synthetic oligonucleotide
cagaggagaaaggaggttgc

SEQ ID NO: 796 - DNA, 19 bp, Artificial Sequence
  Description of Artificial Sequence: Synthetic oligonucleotide
tctgtcgtctgttcgtccc

SEQ ID NO: 797 - DNA, 20 bp, Artificial Sequence
  Description of Artificial Sequence: Synthetic oligonucleotide
aattttggtggaggtggatg

SEQ ID NO: 798 - DNA, 20 bp, Artificial Sequence
  Description of Artificial Sequence: Synthetic oligonucleotide
attggttaagggaggtaccg

SEQ ID NO: 799 - DNA, 21 bp, Artificial Sequence
  Description of Artificial Sequence: Synthetic oligonucleotide
gcctttcgttctgccctcccc

SEQ ID NO: 800 - DNA, 19 bp, Artificial Sequence
  Description of Artificial Sequence: Synthetic oligonucleotide
tccttgtcgtcttgcgtcc

SEQ ID NO: 801 - DNA, 20 bp, Artificial Sequence
  Description of Artificial Sequence: Synthetic oligonucleotide
tctgtacggtggtgaggggg

SEQ ID NO: 802 - DNA, 20 bp, Artificial Sequence
  Description of Artificial Sequence: Synthetic oligonucleotide
tgtagggaggtagtcatcgt

SEQ ID NO: 803 - DNA, 20 bp, Artificial Sequence
  Description of Artificial Sequence: Synthetic oligonucleotide
taggaggaggaggtgttgtg

SEQ ID NO: 804 - DNA, 20 bp, Artificial Sequence
  Description of Artificial Sequence: Synthetic oligonucleotide
tttgatgggcgatgggtccg

SEQ ID NO: 805 - DNA, 20 bp, Artificial Sequence
  Description of Artificial Sequence: Synthetic oligonucleotide
aggcgtctcgtcttatactg

SEQ ID NO: 806 - DNA, 20 bp, Artificial Sequence
  Description of Artificial Sequence: Synthetic oligonucleotide
cagaggcgaagggaggttgc

SEQ ID NO: 807 - DNA, 20 bp, Artificial Sequence
  Description of Artificial Sequence: Synthetic oligonucleotide
tttgtcgtcttgttcgtccc

SEQ ID NO: 808 - DNA, 20 bp, Artificial Sequence
  Description of Artificial Sequence: Synthetic oligonucleotide
ttggacttggaaaccgtggc

SEQ ID NO: 809 - DNA, 20 bp, Artificial Sequence
  Description of Artificial Sequence: Synthetic oligonucleotide
ggtggtgaagggttggtccg

SEQ ID NO: 810 - DNA, 20 bp, Artificial Sequence
  Description of Artificial Sequence: Synthetic oligonucleotide
tataattaggaggaggtggg

SEQ ID NO: 811 - DNA, 20 bp, Artificial Sequence
  Description of Artificial Sequence: Synthetic oligonucleotide
agggagcagggagtttaccg

SEQ ID NO: 812 - DNA, 20 bp, Artificial Sequence
  Description of Artificial Sequence: Synthetic oligonucleotide
tcgggtcctcgcattgtgtg

SEQ ID NO: 813 - DNA, 20 bp, Artificial Sequence
  Description of Artificial Sequence: Synthetic oligonucleotide
gcctttcgttctgaccgccc

SEQ ID NO: 814 - DNA, 20 bp, Artificial Sequence
  Description of Artificial Sequence: Synthetic oligonucleotide
attggtgaaggtaggtaccg

SEQ ID NO: 815 - DNA, 20 bp, Artificial Sequence
  Description of Artificial Sequence: Synthetic oligonucleotide
ttgggtgtacggtggtaccg

SEQ ID NO: 816 - DNA, 20 bp, Artificial Sequence
  Description of Artificial Sequence: Synthetic oligonucleotide
tttgaagggagatgggtccc

SEQ ID NO: 817 - DNA, 20 bp, Artificial Sequence
  Description of Artificial Sequence: Synthetic oligonucleotide
tgtaggaggcggaggtaccg

SEQ ID NO: 818 - DNA, 20 bp, Artificial Sequence
  Description of Artificial Sequence: Synthetic oligonucleotide
tttaggaggaggaggtaccg

SEQ ID NO: 819 - DNA, 20 bp, Artificial Sequence
  Description of Artificial Sequence: Synthetic oligonucleotide
tttgaagggcgttgggtccg

SEQ ID NO: 820 - DNA, 20 bp, Artificial Sequence
  Description of Artificial Sequence: Synthetic oligonucleotide
ttcgtttccttcgtcgtgtg

SEQ ID NO: 821 - DNA, 20 bp, Artificial Sequence
  Description of Artificial Sequence: Synthetic oligonucleotide
ccaagtcgttccatcgtgtg

SEQ ID NO: 822 - DNA, 20 bp, Artificial Sequence
  Description of Artificial Sequence: Synthetic oligonucleotide
tgcctctgtcgttgcttgtg

SEQ ID NO: 823 - DNA, 20 bp, Artificial Sequence
  Description of Artificial Sequence: Synthetic oligonucleotide
tgtaggaagaggaggtaccg

SEQ ID NO: 824 - DNA, 20 bp, Artificial Sequence
  Description of Artificial Sequence: Synthetic oligonucleotide
tctggtgatgttagccggtg

SEQ ID NO: 825 - DNA, 20 bp, Artificial Sequence
  Description of Artificial Sequence: Synthetic oligonucleotide
gatgacggcgactcgcacta

SEQ ID NO: 826 - DNA, 20 bp, Artificial Sequence
  Description of Artificial Sequence: Synthetic oligonucleotide
cgactttttgcctcttggcc

SEQ ID NO: 827 - DNA, 19 bp, Artificial Sequence
  Description of Artificial Sequence: Synthetic oligonucleotide
cagaggagaagggaggtgc

SEQ ID NO: 828 - DNA, 20 bp, Artificial Sequence
  Description of Artificial Sequence: Synthetic oligonucleotide
cagaggagaagggaggttgg

SEQ ID NO: 829 - DNA, 20 bp, Artificial Sequence
  Description of Artificial Sequence: Synthetic oligonucleotide
cttggtgaagggaggtaccg

SEQ ID NO: 830 - DNA, 20 bp, Artificial Sequence
  Description of Artificial Sequence: Synthetic oligonucleotide
gttgctgtagtgcggtgcgc

SEQ ID NO: 831 - DNA, 20 bp, Artificial Sequence
  Description of Artificial Sequence: Synthetic oligonucleotide
tattggaggtgtagtgaccg

SEQ ID NO: 832 - DNA, 20 bp, Artificial Sequence
  Description of Artificial Sequence: Synthetic oligonucleotide
tttgaagggcgatgggtccc

SEQ ID NO: 833 - DNA, 18 bp, Artificial Sequence
  Description of Artificial Sequence: Synthetic oligonucleotide
tttgaaggggtgggtccg

SEQ ID NO: 834 - DNA, 20 bp, Artificial Sequence
  Description of Artificial Sequence: Synthetic oligonucleotide
tgtaggcggaggaggtaccg

SEQ ID NO: 835 - DNA, 20 bp, Artificial Sequence
  Description of Artificial Sequence: Synthetic oligonucleotide
tttgaagagggatgggtccg

SEQ ID NO: 836 - DNA, 20 bp, Artificial Sequence
  Description of Artificial Sequence: Synthetic oligonucleotide
tttgttgggtgatgggtccg

SEQ ID NO: 837 - DNA, 20 bp, Artificial Sequence
  Description of Artificial Sequence: Synthetic oligonucleotide
ttgggtgtagggtggtagcg

SEQ ID NO: 838 - DNA, 20 bp, Artificial Sequence
  Description of Artificial Sequence: Synthetic oligonucleotide
aatcgggccttttgtcactg

SEQ ID NO: 839 - DNA, 20 bp, Artificial Sequence
  Description of Artificial Sequence: Synthetic oligonucleotide
gcctttcgtctgttcgtccc

SEQ ID NO: 840 - DNA, 20 bp, Artificial Sequence
  Description of Artificial Sequence: Synthetic oligonucleotide
tgagtaagtctgtttccccc

SEQ ID NO: 841 - DNA, 20 bp, Artificial Sequence
  Description of Artificial Sequence: Synthetic oligonucleotide
tgtggcaaaattacgctgtg

SEQ ID NO: 842 - DNA, 20 bp, Artificial Sequence
  Description of Artificial Sequence: Synthetic oligonucleotide
tgacagttgtctgcgctcca

SEQ ID NO: 843 - DNA, 20 bp, Artificial Sequence
  Description of Artificial Sequence: Synthetic oligonucleotide
cagaggagaagggcggttgc

SEQ ID NO: 844 - DNA, 20 bp, Artificial Sequence
  Description of Artificial Sequence: Synthetic oligonucleotide
tcctgtcgtctattcgtccc

SEQ ID NO: 845 - DNA, 20 bp, Artificial Sequence
  Description of Artificial Sequence: Synthetic oligonucleotide
ccaacaaatcatgtgtgccc

SEQ ID NO: 846 - DNA, 20 bp, Artificial Sequence
  Description of Artificial Sequence: Synthetic oligonucleotide
aatttgtcctcggtcgtgtg

SEQ ID NO: 847 - DNA, 20 bp, Artificial Sequence
  Description of Artificial Sequence: Synthetic oligonucleotide
atgtgtccttaccagtgccc

SEQ ID NO: 848 - DNA, 20 bp, Artificial Sequence
  Description of Artificial Sequence: Synthetic oligonucleotide
ccattgaacctcccgttggc

SEQ ID NO: 849 - DNA, 20 bp, Artificial Sequence
  Description of Artificial Sequence: Synthetic oligonucleotide
tcgatcgttcttgcctacgc

SEQ ID NO: 850 - DNA, 20 bp, Artificial Sequence
  Description of Artificial Sequence: Synthetic oligonucleotide
acctccagttgtctgtacgc

SEQ ID NO: 851 - DNA, 20 bp, Artificial Sequence
  Description of Artificial Sequence: Synthetic oligonucleotide
ttgggtgtagggtgttactg

SEQ ID NO: 852 - DNA, 20 bp, Artificial Sequence
  Description of Artificial Sequence: Synthetic oligonucleotide
ttgggtgtaggggggtactg

SEQ ID NO: 853 - DNA, 20 bp, Artificial Sequence
  Description of Artificial Sequence: Synthetic oligonucleotide
aacgtgtcgctttgctgccc

SEQ ID NO: 854 - DNA, 20 bp, Artificial Sequence
  Description of Artificial Sequence: Synthetic oligonucleotide
tgtggcgtgtcatctccgtg

SEQ ID NO: 855 - DNA, 20 bp, Artificial Sequence
  Description of Artificial Sequence: Synthetic oligonucleotide
ttgggagtagggtgttaccg

SEQ ID NO: 856 - DNA, 20 bp, Artificial Sequence
  Description of Artificial Sequence: Synthetic oligonucleotide
tgtaggagaaggaggtaccg

SEQ ID NO: 857 - DNA, 20 bp, Artificial Sequence
  Description of Artificial Sequence: Synthetic oligonucleotide
ttgggtgtagggagttaccg

SEQ ID NO: 858 - DNA, 20 bp, Artificial Sequence
  Description of Artificial Sequence: Synthetic oligonucleotide
tgtaggaggaggaggtacgg

SEQ ID NO: 859 - DNA, 19 bp, Artificial Sequence
  Description of Artificial Sequence: Synthetic oligonucleotide
cttgtcgtcttgttgtccc

SEQ ID NO: 860 - DNA, 20 bp, Artificial Sequence
  Description of Artificial Sequence: Synthetic oligonucleotide
tgtaggtggaggaggtaccg

SEQ ID NO: 861 - DNA, 20 bp, Artificial Sequence
  Description of Artificial Sequence: Synthetic oligonucleotide
tttggaggaggatgggtccg

SEQ ID NO: 862 - DNA, 20 bp, Artificial Sequence
  Description of Artificial Sequence: Synthetic oligonucleotide
tgtagtaggaggaggtaccg

SEQ ID NO: 863 - DNA, 20 bp, Artificial Sequence
  Description of Artificial Sequence: Synthetic oligonucleotide
ggatagtctggtttgcccgc

SEQ ID NO: 864 - DNA, 20 bp, Artificial Sequence
  Description of Artificial Sequence: Synthetic oligonucleotide
cagaggagaaggtaggttgc

SEQ ID NO: 865 - DNA, 20 bp, Artificial Sequence
  Description of Artificial Sequence: Synthetic oligonucleotide
cgtcccttcgtcttgtgcgc

SEQ ID NO: 866 - DNA, 20 bp, Artificial Sequence
  Description of Artificial Sequence: Synthetic oligonucleotide
ttgggtgtagggtggtgctg

SEQ ID NO: 867 - DNA, 20 bp, Artificial Sequence
  Description of Artificial Sequence: Synthetic oligonucleotide
gcaatttcgtctagtgtccc

SEQ ID NO: 868 - DNA, 20 bp, Artificial Sequence
  Description of Artificial Sequence: Synthetic oligonucleotide
atgtcaactacccgtgaccg

SEQ ID NO: 869 - DNA, 20 bp, Artificial Sequence
  Description of Artificial Sequence: Synthetic oligonucleotide
gcctttcgttctgccccctc

SEQ ID NO: 870 - DNA, 19 bp, Artificial Sequence
  Description of Artificial Sequence: Synthetic oligonucleotide
ccgtacgttgtctcctgtg

SEQ ID NO: 871 - DNA, 20 bp, Artificial Sequence
  Description of Artificial Sequence: Synthetic oligonucleotide
tccatcacactaagccgcac

SEQ ID NO: 872 - DNA, 20 bp, Artificial Sequence
  Description of Artificial Sequence: Synthetic oligonucleotide
tgagtcagaatctgctgccc

SEQ ID NO: 873 - DNA, 22 bp, Artificial Sequence
  Description of Artificial Sequence: Synthetic oligonucleotide
tttttggttttttttttgcccg

SEQ ID NO: 874 - DNA, 20 bp, Artificial Sequence
  Description of Artificial Sequence: Synthetic oligonucleotide
tgactcgtctgttttgtccc

SEQ ID NO: 875 - DNA, 20 bp, Artificial Sequence
  Description of Artificial Sequence: Synthetic oligonucleotide
gcctttcgttcggacctccc

SEQ ID NO: 876 - DNA, 20 bp, Artificial Sequence
  Description of Artificial Sequence: Synthetic oligonucleotide
ggtaggaggaggaggtaccg

SEQ ID NO: 877 - DNA, 20 bp, Artificial Sequence
  Description of Artificial Sequence: Synthetic oligonucleotide
tataggaggaggaggtaccg

SEQ ID NO: 878 - DNA, 20 bp, Artificial Sequence
  Description of Artificial Sequence: Synthetic oligonucleotide
tatcggaggtgtagggaccg

SEQ ID NO: 879 - DNA, 20 bp, Artificial Sequence
  Description of Artificial Sequence: Synthetic oligonucleotide
attgaagggggatgggtccg

SEQ ID NO: 880 - DNA, 20 bp, Artificial Sequence
  Description of Artificial Sequence: Synthetic oligonucleotide
tttgtagggagatgggtccg

SEQ ID NO: 881 - DNA, 20 bp, Artificial Sequence
  Description of Artificial Sequence: Synthetic oligonucleotide
tttgaggggcgatgggtccg

SEQ ID NO: 882 - DNA, 19 bp, Artificial Sequence
  Description of Artificial Sequence: Synthetic oligonucleotide
attggtgaagggaggtact

SEQ ID NO: 883 - DNA, 20 bp, Artificial Sequence
  Description of Artificial Sequence: Synthetic oligonucleotide
ttgggtgtagggtggtattg

SEQ ID NO: 884 - DNA, 20 bp, Artificial Sequence
  Description of Artificial Sequence: Synthetic oligonucleotide
ttgggtgtagggcggaaccg

SEQ ID NO: 885 - DNA, 20 bp, Artificial Sequence
  Description of Artificial Sequence: Synthetic oligonucleotide
tttgaagggtggtaggtccg

SEQ ID NO: 886 - DNA, 20 bp, Artificial Sequence
  Description of Artificial Sequence: Synthetic oligonucleotide
cttgaagggtgatggggccg

SEQ ID NO: 887 - DNA, 20 bp, Artificial Sequence
  Description of Artificial Sequence: Synthetic oligonucleotide
attggtgtagggtgttaccg

SEQ ID NO: 888 - DNA, 20 bp, Artificial Sequence
  Description of Artificial Sequence: Synthetic oligonucleotide
cagaggagaagggatgttgc

SEQ ID NO: 889 - DNA, 20 bp, Artificial Sequence
  Description of Artificial Sequence: Synthetic oligonucleotide
tccgctcgcacattcgtctg

SEQ ID NO: 890 - DNA, 20 bp, Artificial Sequence
  Description of Artificial Sequence: Synthetic oligonucleotide
ttgggcgtagggtgttaccg

SEQ ID NO: 891 - DNA, 20 bp, Artificial Sequence
  Description of Artificial Sequence: Synthetic oligonucleotide
ctgggtgtagggtgttaccg

SEQ ID NO: 892 - DNA, 20 bp, Artificial Sequence
  Description of Artificial Sequence: Synthetic oligonucleotide
tttggggttctcccgtgccc

SEQ ID NO: 893 - DNA, 20 bp, Artificial Sequence
  Description of Artificial Sequence: Synthetic oligonucleotide
tgtaggaggaagaggtaccg

SEQ ID NO: 894 - DNA, 20 bp, Artificial Sequence
  Description of Artificial Sequence: Synthetic oligonucleotide
gtcgtcagttttccgctccc

SEQ ID NO: 895 - DNA, 20 bp, Artificial Sequence
  Description of Artificial Sequence: Synthetic oligonucleotide
agtgcgatggtctgtgtgtg

SEQ ID NO: 896 - DNA, 21 bp, Artificial Sequence
  Description of Artificial Sequence: Synthetic oligonucleotide
attgggtgtagggtggtaccg

SEQ ID NO: 897 - DNA, 20 bp, Artificial Sequence
  Description of Artificial Sequence: Synthetic oligonucleotide
tgtaggaggaggagataccg

SEQ ID NO: 898 - DNA, 19 bp, Artificial Sequence
  Description of Artificial Sequence: Synthetic oligonucleotide
atcgtccgttcgtctgccc

SEQ ID NO: 899 - DNA, 19 bp, Artificial Sequence
  Description of Artificial Sequence: Synthetic oligonucleotide
tgactcgtctgtttcgtcc

SEQ ID NO: 900 - DNA, 20 bp, Artificial Sequence
  Description of Artificial Sequence: Synthetic oligonucleotide
atttgtgaagggaggtaccg

SEQ ID NO: 901 - DNA, 20 bp, Artificial Sequence
  Description of Artificial Sequence: Synthetic oligonucleotide
cctgtcgtcttgttcgtccc

SEQ ID NO: 902 - DNA, 20 bp, Artificial Sequence
  Description of Artificial Sequence: Synthetic oligonucleotide
tcctgtcgtctgatcgtccc

SEQ ID NO: 903 - DNA, 21 bp, Artificial Sequence
  Description of Artificial Sequence: Synthetic oligonucleotide
ttttgaagggtggtgggtccg

SEQ ID NO: 904 - DNA, 20 bp, Artificial Sequence
  Description of Artificial Sequence: Synthetic oligonucleotide
tttggagggtggtgggaccg

SEQ ID NO: 905 - DNA, 20 bp, Artificial Sequence
  Description of Artificial Sequence: Synthetic oligonucleotide
ttgggagtaggatgggaccg

SEQ ID NO: 906 - DNA, 20 bp, Artificial Sequence
  Description of Artificial Sequence: Synthetic oligonucleotide
ttgggtgtagggaggaaccg

SEQ ID NO: 907 - DNA, 20 bp, Artificial Sequence
  Description of Artificial Sequence: Synthetic oligonucleotide
tattggaggtgaagggaccg

SEQ ID NO: 908 - DNA, 18 bp, Artificial Sequence
  Description of Artificial Sequence: Synthetic oligonucleotide
gggtgtagggtggtaccg

SEQ ID NO: 909 - DNA, 22 bp, Artificial Sequence
  Description of Artificial Sequence: Synthetic oligonucleotide
ctattggtgaagggaggtactg

SEQ ID NO: 910 - DNA, 20 bp, Artificial Sequence
  Description of Artificial Sequence: Synthetic oligonucleotide
gttggtccgtcctgcgtgtg

SEQ ID NO: 911 - DNA, 20 bp, Artificial Sequence
  Description of Artificial Sequence: Synthetic oligonucleotide
agtcctgtcgtttgtggcgc

SEQ ID NO: 912 - DNA, 20 bp, Artificial Sequence
  Description of Artificial Sequence: Synthetic oligonucleotide
cagaggagaagggaggtcgc

SEQ ID NO: 913 - DNA, 20 bp, Artificial Sequence
  Description of Artificial Sequence: Synthetic oligonucleotide
gtcctgtcgtctgttgtccc

SEQ ID NO: 914 - DNA, 20 bp, Artificial Sequence
  Description of Artificial Sequence: Synthetic oligonucleotide
gttgagccttcttcgttgtg

SEQ ID NO: 915 - DNA, 21 bp, Artificial Sequence
  Description of Artificial Sequence: Synthetic oligonucleotide
gcctttcgttctgccctaccc

SEQ ID NO: 916 - DNA, 20 bp, Artificial Sequence
  Description of Artificial Sequence: Synthetic oligonucleotide
taccgcgtcgtttgctgcgg

SEQ ID NO: 917 - DNA, 19 bp, Artificial Sequence
  Description of Artificial Sequence: Synthetic oligonucleotide
tcctgtcgtctgctgtccc

SEQ ID NO: 918 - DNA, 19 bp, Artificial Sequence
  Description of Artificial Sequence: Synthetic oligonucleotide
gcctttcgttcgacctccc

SEQ ID NO: 919 - DNA, 20 bp, Artificial Sequence
  Description of Artificial Sequence: Synthetic oligonucleotide
gctcttcgttctgacctccc

SEQ ID NO: 920 - DNA, 20 bp, Artificial Sequence
  Description of Artificial Sequence: Synthetic oligonucleotide
cagaggagaagggaggttga

SEQ ID NO: 921 - DNA, 20 bp, Artificial Sequence
  Description of Artificial Sequence: Synthetic oligonucleotide
tgtaggaggaggcggtaccg

SEQ ID NO: 922 - DNA, 20 bp, Artificial Sequence
  Description of Artificial Sequence: Synthetic oligonucleotide
tgagtcgatgttgccgtgtc

SEQ ID NO: 923 - DNA, 20 bp, Artificial Sequence
  Description of Artificial Sequence: Synthetic oligonucleotide
taacctatgtgtggttgcgc

SEQ ID NO: 924 - DNA, 18 bp, Artificial Sequence
  Description of Artificial Sequence: Synthetic oligonucleotide
tttgaagggttgggtccg

SEQ ID NO: 925 - DNA, 20 bp, Artificial Sequence
  Description of Artificial Sequence: Synthetic oligonucleotide
tttgaatggagatgggtccg

SEQ ID NO: 926 - DNA, 21 bp, Artificial Sequence
  Description of Artificial Sequence: Synthetic oligonucleotide
gtcctgtcgtctgttcgtccg

SEQ ID NO: 927 - DNA, 20 bp, Artificial Sequence
  Description of Artificial Sequence: Synthetic oligonucleotide
ccctatgttctcccgtgccc

SEQ ID NO: 928 - DNA, 20 bp, Artificial Sequence
  Description of Artificial Sequence: Synthetic oligonucleotide
tttggaggatggtgggaccg

SEQ ID NO: 929 - DNA, 20 bp, Artificial Sequence
  Description of Artificial Sequence: Synthetic oligonucleotide
attggagaagggtgggactg

SEQ ID NO: 930 - DNA, 20 bp, Artificial Sequence
  Description of Artificial Sequence: Synthetic oligonucleotide
attggtgaggggagggactg

SEQ ID NO: 931 - DNA, 19 bp, Artificial Sequence
  Description of Artificial Sequence: Synthetic oligonucleotide
ttgggtgtagggtggtacc

SEQ ID NO: 932 - DNA, 20 bp, Artificial Sequence
  Description of Artificial Sequence: Synthetic oligonucleotide
ttgggagtggggtgggaccg

SEQ ID NO: 933 - DNA, 20 bp, Artificial Sequence
  Description of Artificial Sequence: Synthetic oligonucleotide
attggagaagggagggaccg

SEQ ID NO: 934 - DNA, 20 bp, Artificial Sequence
  Description of Artificial Sequence: Synthetic oligonucleotide
tgtaggatgaggaggtaccg

SEQ ID NO: 935 - DNA, 20 bp, Artificial Sequence
  Description of Artificial Sequence: Synthetic oligonucleotide
tttgaagggtggtgggcccg

SEQ ID NO: 936 - DNA, 19 bp, Artificial Sequence
  Description of Artificial Sequence: Synthetic oligonucleotide
gtcttctggctatcgtccc

SEQ ID NO: 937 - DNA, 20 bp, Artificial Sequence
  Description of Artificial Sequence: Synthetic oligonucleotide
gtgattgctgccgtcctgtg

SEQ ID NO: 938 - DNA, 20 bp, Artificial Sequence
  Description of Artificial Sequence: Synthetic oligonucleotide
gttgtcatatactccccccc

SEQ ID NO: 939 - DNA, 20 bp, Artificial Sequence
  Description of Artificial Sequence: Synthetic oligonucleotide
ttgggagtagggtggtactg

SEQ ID NO: 940 - DNA, 19 bp, Artificial Sequence
  Description of Artificial Sequence: Synthetic oligonucleotide
gcctttcgttctacctccc

SEQ ID NO: 941 - DNA, 18 bp, Artificial Sequence
  Description of Artificial Sequence: Synthetic oligonucleotide
tccttgtcgtcttgtccc

SEQ ID NO: 942 - DNA, 20 bp, Artificial Sequence
  Description of Artificial Sequence: Synthetic oligonucleotide
catagtcctgtcgtgttgca

SEQ ID NO: 943 - DNA, 19 bp, Artificial Sequence
  Description of Artificial Sequence: Synthetic oligonucleotide
tatcgttacccgtttgccc

SEQ ID NO: 944 - DNA, 20 bp, Artificial Sequence
  Description of Artificial Sequence: Synthetic oligonucleotide
cgatttgtcttccacgtgtg

SEQ ID NO: 945 - DNA, 20 bp, Artificial Sequence
  Description of Artificial Sequence: Synthetic oligonucleotide
tttgaagggtggtgggtctg

SEQ ID NO: 946 - DNA, 20 bp, Artificial Sequence
  Description of Artificial Sequence: Synthetic oligonucleotide
tttgaagggagatggttccg

SEQ ID NO: 947 - DNA, 20 bp, Artificial Sequence
  Description of Artificial Sequence: Synthetic oligonucleotide
tattggaggtgttgggaccg

SEQ ID NO: 948 - DNA, 20 bp, Artificial Sequence
  Description of Artificial Sequence: Synthetic oligonucleotide
ttgggtgtagggaggcaccg

SEQ ID NO: 949 - DNA, 20 bp, Artificial Sequence
  Description of Artificial Sequence: Synthetic oligonucleotide
tgtaggaggaggaggtatcg

SEQ ID NO: 950 - DNA, 20 bp, Artificial Sequence
  Description of Artificial Sequence: Synthetic oligonucleotide
ttgggagtggggtggtaccg

SEQ ID NO: 951 - DNA, 18 bp, Artificial Sequence
  Description of Artificial Sequence: Synthetic oligonucleotide
tattggaggtagggaccg

SEQ ID NO: 952 - DNA, 20 bp, Artificial Sequence
  Description of Artificial Sequence: Synthetic oligonucleotide
cagaagagaagggaggttgc

SEQ ID NO: 953 - DNA, 20 bp, Artificial Sequence
  Description of Artificial Sequence: Synthetic oligonucleotide
ttctcagtattggtcgtggc

SEQ ID NO: 954 - DNA, 20 bp, Artificial Sequence
  Description of Artificial Sequence: Synthetic oligonucleotide
tggcctgtcgtctacgtgtg

SEQ ID NO: 955 - DNA, 21 bp, Artificial Sequence
  Description of Artificial Sequence: Synthetic oligonucleotide
acgtggtgtagggtggtaccg

SEQ ID NO: 956 - DNA, 20 bp, Artificial Sequence
  Description of Artificial Sequence: Synthetic oligonucleotide
gtcgattcgtttgtcctgcc

SEQ ID NO: 957 - DNA, 20 bp, Artificial Sequence
  Description of Artificial Sequence: Synthetic oligonucleotide
tcctgtgttgtcttacactg

SEQ ID NO: 958 - DNA, 20 bp, Artificial Sequence
  Description of Artificial Sequence: Synthetic oligonucleotide
gccttacgttctgacctccc

SEQ ID NO: 959 - DNA, 20 bp, Artificial Sequence
  Description of Artificial Sequence: Synthetic oligonucleotide
tgcgagtgtttgctgtgccc

SEQ ID NO: 960 - DNA, 20 bp, Artificial Sequence
  Description of Artificial Sequence: Synthetic oligonucleotide
atcctcaccctgtcgtgctg

SEQ ID NO: 961 - DNA, 20 bp, Artificial Sequence
  Description of Artificial Sequence: Synthetic oligonucleotide
atgcgagggaggagggtgtg

SEQ ID NO: 962 - DNA, 19 bp, Artificial Sequence
  Description of Artificial Sequence: Synthetic oligonucleotide
attggtgaagggggtactg

SEQ ID NO: 963 - DNA, 18 bp, Artificial Sequence
  Description of Artificial Sequence: Synthetic oligonucleotide
tcgttccctcgtcgtgtg

SEQ ID NO: 964 - DNA, 20 bp, Artificial Sequence
  Description of Artificial Sequence: Synthetic oligonucleotide
cttgtcgtcttgctcgtccc

SEQ ID NO: 965 - DNA, 20 bp, Artificial Sequence
  Description of Artificial Sequence: Synthetic oligonucleotide
tcctgtcgtctgttcgtcac

SEQ ID NO: 966 - DNA, 20 bp, Artificial Sequence
  Description of Artificial Sequence: Synthetic oligonucleotide
attcctccgcgtgtcgtttg

SEQ ID NO: 967 - DNA, 20 bp, Artificial Sequence
  Description of Artificial Sequence: Synthetic oligonucleotide
attggagaagggtggtactg

SEQ ID NO: 968 - DNA, 20 bp, Artificial Sequence
  Description of Artificial Sequence: Synthetic oligonucleotide
aattataggtggacttgcat

SEQ ID NO: 969 - DNA, 20 bp, Artificial Sequence
  Description of Artificial Sequence: Synthetic oligonucleotide
attggaggagggagggactg

SEQ ID NO: 970 - DNA, 18 bp, Artificial Sequence
  Description of Artificial Sequence: Synthetic oligonucleotide
gcttcgttctgccctccc

SEQ ID NO: 971 - DNA, 20 bp, Artificial Sequence
  Description of Artificial Sequence: Synthetic oligonucleotide
tttggggttttcccgttccc

SEQ ID NO: 972 - DNA, 20 bp, Artificial Sequence
  Description of Artificial Sequence: Synthetic oligonucleotide
atctcatggggtgatgtccc

SEQ ID NO: 973 - DNA, 19 bp, Artificial Sequence
  Description of Artificial Sequence: Synthetic oligonucleotide
attggtgaagggaggtatg

SEQ ID NO: 974 - DNA, 19 bp, Artificial Sequence
  Description of Artificial Sequence: Synthetic oligonucleotide
ttgggtgtgggtggtaccg

SEQ ID NO: 975 - DNA, 20 bp, Artificial Sequence
  Description of Artificial Sequence: Synthetic oligonucleotide
tcctgtcgtctgttcctccc

SEQ ID NO: 976 - DNA, 20 bp, Artificial Sequence
  Description of Artificial Sequence: Synthetic oligonucleotide
tttgaagggggatgggtcgg

SEQ ID NO: 977 - DNA, 20 bp, Artificial Sequence
  Description of Artificial Sequence: Synthetic oligonucleotide
tttgaagggctatgggtccg

SEQ ID NO: 978 - DNA, 20 bp, Artificial Sequence
  Description of Artificial Sequence: Synthetic oligonucleotide
tttgaaggtagatgggtccg

SEQ ID NO: 979 - DNA, 20 bp, Artificial Sequence
  Description of Artificial Sequence: Synthetic oligonucleotide
tgtagggaggaagttatcgt

SEQ ID NO: 980 - DNA, 20 bp, Artificial Sequence
  Description of Artificial Sequence: Synthetic oligonucleotide
ttgggtgaagggcggtaccg

SEQ ID NO: 981 - DNA, 20 bp, Artificial Sequence
  Description of Artificial Sequence: Synthetic oligonucleotide
tgtagggaggtagttatcgg

SEQ ID NO: 982 - DNA, 19 bp, Artificial Sequence
  Description of Artificial Sequence: Synthetic oligonucleotide
cagaggagaagggaggttg

SEQ ID NO: 983 - DNA, 20 bp, Artificial Sequence
  Description of Artificial Sequence: Synthetic oligonucleotide
gtttgcgtctgacctgtccc

SEQ ID NO: 984 - DNA, 20 bp, Artificial Sequence
  Description of Artificial Sequence: Synthetic oligonucleotide
cttgtcgtcttgtttctccc

SEQ ID NO: 985 - DNA, 20 bp, Artificial Sequence
  Description of Artificial Sequence: Synthetic oligonucleotide
tagcgtcgtctggccatgtg

SEQ ID NO: 986 - DNA, 20 bp, Artificial Sequence
  Description of Artificial Sequence: Synthetic oligonucleotide
tcatgtcctgccacgttgcc

SEQ ID NO: 987 - DNA, 20 bp, Artificial Sequence
  Description of Artificial Sequence: Synthetic oligonucleotide
tcccaaatgcctcccgtgtg

SEQ ID NO: 988 - DNA, 20 bp, Artificial Sequence
  Description of Artificial Sequence: Synthetic oligonucleotide
tcgtttggtctctggtgccc

SEQ ID NO: 989 - DNA, 20 bp, Artificial Sequence
  Description of Artificial Sequence: Synthetic oligonucleotide
tgtaggagtaggaggtaccg

SEQ ID NO: 990 - DNA, 20 bp, Artificial Sequence
  Description of Artificial Sequence: Synthetic oligonucleotide
actgatatcctcccgttggc

SEQ ID NO: 991 - DNA, 20 bp, Artificial Sequence
  Description of Artificial Sequence: Synthetic oligonucleotide
agtgggctgtggtgtacgtg

SEQ ID NO: 992 - DNA, 20 bp, Artificial Sequence
  Description of Artificial Sequence: Synthetic oligonucleotide
tttgaagggcgatgggtcag

SEQ ID NO: 993 - DNA, 20 bp, Artificial Sequence
  Description of Artificial Sequence: Synthetic oligonucleotide
tgtaagaggaggaggtaccg

SEQ ID NO: 994 - DNA, 21 bp, Artificial Sequence
  Description of Artificial Sequence: Synthetic oligonucleotide
gtcctgttgtctgttcgtccc

SEQ ID NO: 995 - DNA, 20 bp, Artificial Sequence
  Description of Artificial Sequence: Synthetic oligonucleotide
aattcgtgcttcgcggtcgc

SEQ ID NO: 996 - DNA, 19 bp, Artificial Sequence
  Description of Artificial Sequence: Synthetic oligonucleotide
ttgggtgtagggtggtacg

SEQ ID NO: 997 - DNA, 20 bp, Artificial Sequence
  Description of Artificial Sequence: Synthetic oligonucleotide
ttgggagtaggatggtaccg

SEQ ID NO: 998 - DNA, 20 bp, Artificial Sequence
  Description of Artificial Sequence: Synthetic oligonucleotide
tttgaagggtggtggttccg

SEQ ID NO: 999 - DNA, 21 bp, Artificial Sequence
  Description of Artificial Sequence: Synthetic oligonucleotide
gcggggtgtagggtggtaccg

SEQ ID NO: 1000 - DNA, 20 bp, Artificial Sequence
  Description of Artificial Sequence: Synthetic oligonucleotide
tattggaggtgcagggaccg

SEQ ID NO: 1001 - DNA, 20 bp, Artificial Sequence
  Description of Artificial Sequence: Synthetic oligonucleotide
ttcgaagggggatgggtccg

SEQ ID NO: 1002 - DNA, 20 bp, Artificial Sequence
  Description of Artificial Sequence: Synthetic oligonucleotide
tgtagggagggagttatcgt

SEQ ID NO: 1003 - DNA, 20 bp, Artificial Sequence
  Description of Artificial Sequence: Synthetic oligonucleotide
ccgcttcgtcacgtgctgtg

SEQ ID NO: 1004 - DNA, 20 bp, Artificial Sequence
  Description of Artificial Sequence: Synthetic oligonucleotide
cgactcctctggttcgtccc

SEQ ID NO: 1005 - DNA, 20 bp, Artificial Sequence
  Description of Artificial Sequence: Synthetic oligonucleotide
atcctcgaacgttgtgtcgc

SEQ ID NO: 1006 - DNA, 20 bp, Artificial Sequence
  Description of Artificial Sequence: Synthetic oligonucleotide
ttagcctcccgactgctcgc

SEQ ID NO: 1007 - DNA, 20 bp, Artificial Sequence
  Description of Artificial Sequence: Synthetic oligonucleotide
aatcccgtcgtcttgcgcgc

SEQ ID NO: 1008 - DNA, 20 bp, Artificial Sequence
  Description of Artificial Sequence: Synthetic oligonucleotide
ccgctgtcttccgtagtctg

SEQ ID NO: 1009 - DNA, 20 bp, Artificial Sequence
  Description of Artificial Sequence: Synthetic oligonucleotide
tgtaggaggaggatgtaccg

SEQ ID NO: 1010 - DNA, 20 bp, Artificial Sequence
  Description of Artificial Sequence: Synthetic oligonucleotide
ccatattgtcccgtctgctg

SEQ ID NO: 1011 - DNA, 20 bp, Artificial Sequence
  Description of Artificial Sequence: Synthetic oligonucleotide
ttagccgttctggtgttggc

SEQ ID NO: 1012 - DNA, 19 bp, Artificial Sequence
  Description of Artificial Sequence: Synthetic oligonucleotide
tcctgtcgtccttcgtccc

SEQ ID NO: 1013 - DNA, 18 bp, Artificial Sequence
  Description of Artificial Sequence: Synthetic oligonucleotide
tcctggtctgttcgtccc

SEQ ID NO: 1014 - DNA, 20 bp, Artificial Sequence
  Description of Artificial Sequence: Synthetic oligonucleotide
tcgacatacgtctgtgcccc

SEQ ID NO: 1015 - DNA, 20 bp, Artificial Sequence
  Description of Artificial Sequence: Synthetic oligonucleotide
tcagagagcctcctgctccc

SEQ ID NO: 1016 - DNA, 20 bp, Artificial Sequence
  Description of Artificial Sequence: Synthetic oligonucleotide
atagttggactggtgctgtg

SEQ ID NO: 1017 - DNA, 20 bp, Artificial Sequence
  Description of Artificial Sequence: Synthetic oligonucleotide
catttttggttggacagctg

SEQ ID NO: 1018 - DNA, 20 bp, Artificial Sequence
  Description of Artificial Sequence: Synthetic oligonucleotide
atcctcctggtcgtggtgtc

SEQ ID NO: 1019 - DNA, 20 bp, Artificial Sequence
  Description of Artificial Sequence: Synthetic oligonucleotide
tgtgtcgtccacaatgtgtg

SEQ ID NO: 1020 - DNA, 20 bp, Artificial Sequence
  Description of Artificial Sequence: Synthetic oligonucleotide
agcgtagttgcatgctgccc

SEQ ID NO: 1021 - DNA, 19 bp, Artificial Sequence
  Description of Artificial Sequence: Synthetic oligonucleotide
cctgttgtctgatgcgcgc

SEQ ID NO: 1022 - DNA, 19 bp, Artificial Sequence
  Description of Artificial Sequence: Synthetic oligonucleotide
gcctttcgttctgtctccc

SEQ ID NO: 1023 - DNA, 20 bp, Artificial Sequence
  Description of Artificial Sequence: Synthetic oligonucleotide
tcctgtcgtctgttcgaccc

SEQ ID NO: 1024 - DNA, 20 bp, Artificial Sequence
  Description of Artificial Sequence: Synthetic oligonucleotide
tgccgcgataccatgctcgc

SEQ ID NO: 1025 - DNA, 20 bp, Artificial Sequence
  Description of Artificial Sequence: Synthetic oligonucleotide
tgactcgtctgtttcgtccg

SEQ ID NO: 1026 - DNA, 20 bp, Artificial Sequence
  Description of Artificial Sequence: Synthetic oligonucleotide
tcctgtcgtctgttagtccc

SEQ ID NO: 1027 - DNA, 20 bp, Artificial Sequence
  Description of Artificial Sequence: Synthetic oligonucleotide
tcctttcgtctgttcgtccc

SEQ ID NO: 1028 - DNA, 20 bp, Artificial Sequence
  Description of Artificial Sequence: Synthetic oligonucleotide
tttgaagagagatgggtccg

SEQ ID NO: 1029 - DNA, 21 bp, Artificial Sequence
  Description of Artificial Sequence: Synthetic oligonucleotide
tttgaagggtgatgggtcccg

SEQ ID NO: 1030 - DNA, 20 bp, Artificial Sequence
  Description of Artificial Sequence: Synthetic oligonucleotide
attgttgaagggaggtaccg

SEQ ID NO: 1031 - DNA, 19 bp, Artificial Sequence
  Description of Artificial Sequence: Synthetic oligonucleotide
cttgtcgtctgttcgtccc

SEQ ID NO: 1032 - DNA, 20 bp, Artificial Sequence
  Description of Artificial Sequence: Synthetic oligonucleotide
tgtaggaggaggaggtacag

SEQ ID NO: 1033 - DNA, 20 bp, Artificial Sequence
  Description of Artificial Sequence: Synthetic oligonucleotide
tactggaggtgtagggaccg

SEQ ID NO: 1034 - DNA, 20 bp, Artificial Sequence
  Description of Artificial Sequence: Synthetic oligonucleotide
tttggtgtagggaggtaccg

SEQ ID NO: 1035 - DNA, 20 bp, Artificial Sequence
  Description of Artificial Sequence: Synthetic oligonucleotide
tttgaagggtgatggtgccg

SEQ ID NO: 1036 - DNA, 20 bp, Artificial Sequence
  Description of Artificial Sequence: Synthetic oligonucleotide
ttggggggagggtggtaccg

SEQ ID NO: 1037 - DNA, 20 bp, Artificial Sequence
  Description of Artificial Sequence: Synthetic oligonucleotide
tattggaggtgtagggacgg

SEQ ID NO: 1038 - DNA, 20 bp, Artificial Sequence
  Description of Artificial Sequence: Synthetic oligonucleotide
agtaggaggaggaggtaccg

SEQ ID NO: 1039 - DNA, 21 bp, Artificial Sequence
  Description of Artificial Sequence: Synthetic oligonucleotide
ttgggtgtaggggggttaccg

SEQ ID NO: 1040 - DNA, 20 bp, Artificial Sequence
  Description of Artificial Sequence: Synthetic oligonucleotide
atagggagaagggtgaactg

SEQ ID NO: 1041 - DNA, 20 bp, Artificial Sequence
  Description of Artificial Sequence: Synthetic oligonucleotide
ttgggtgtaggggggaaccg

SEQ ID NO: 1042 - DNA, 20 bp, Artificial Sequence
  Description of Artificial Sequence: Synthetic oligonucleotide
taagatggtgagcacgtgtc

SEQ ID NO: 1043 - DNA, 20 bp, Artificial Sequence
  Description of Artificial Sequence: Synthetic oligonucleotide
ttcgttttgctccccgtgtg

SEQ ID NO: 1044 - DNA, 20 bp, Artificial Sequence
  Description of Artificial Sequence: Synthetic oligonucleotide
gaggtgtctggatgtctgtg

SEQ ID NO: 1045 - DNA, 20 bp, Artificial Sequence
  Description of Artificial Sequence: Synthetic oligonucleotide
cattgtcccggtcggtactg

SEQ ID NO: 1046 - DNA, 20 bp, Artificial Sequence
  Description of Artificial Sequence: Synthetic oligonucleotide
taccgctcacttgtcgtgtg

SEQ ID NO: 1047 - DNA, 20 bp, Artificial Sequence
  Description of Artificial Sequence: Synthetic oligonucleotide
atgggtcgtctttacctccc

SEQ ID NO: 1048 - DNA, 20 bp, Artificial Sequence
  Description of Artificial Sequence: Synthetic oligonucleotide
tggtctctggttctgtgggc

SEQ ID NO: 1049 - DNA, 20 bp, Artificial Sequence
  Description of Artificial Sequence: Synthetic oligonucleotide
atgatgttgtcccatgtgtg

SEQ ID NO: 1050 - DNA, 20 bp, Artificial Sequence
  Description of Artificial Sequence: Synthetic oligonucleotide
tgtcgagttttttggtgccc

SEQ ID NO: 1051 - DNA, 20 bp, Artificial Sequence
  Description of Artificial Sequence: Synthetic oligonucleotide
tcctgtagtctgttcgtccc

SEQ ID NO: 1052 - DNA, 20 bp, Artificial Sequence
  Description of Artificial Sequence: Synthetic oligonucleotide
atgtgtgagatgccctgcgc

SEQ ID NO: 1053 - DNA, 20 bp, Artificial Sequence
  Description of Artificial Sequence: Synthetic oligonucleotide
tcctgtcttgtcgttgtccc

SEQ ID NO: 1054 - DNA, 20 bp, Artificial Sequence
  Description of Artificial Sequence: Synthetic oligonucleotide
acgttgtcccactgtgtcgc

SEQ ID NO: 1055 - DNA, 20 bp, Artificial Sequence
  Description of Artificial Sequence: Synthetic oligonucleotide
gcctttggttctgacctccc

SEQ ID NO: 1056 - DNA, 19 bp, Artificial Sequence
  Description of Artificial Sequence: Synthetic oligonucleotide
tttgatggtgatgggtccg

SEQ ID NO: 1057 - DNA, 19 bp, Artificial Sequence
  Description of Artificial Sequence: Synthetic oligonucleotide
tttggggttttccgtgccc

SEQ ID NO: 1058 - DNA, 21 bp, Artificial Sequence
  Description of Artificial Sequence: Synthetic oligonucleotide
attggtgaaggggaggtactg

SEQ ID NO: 1059 - DNA, 20 bp, Artificial Sequence
  Description of Artificial Sequence: Synthetic oligonucleotide
tgagtggttatggaccggtg

SEQ ID NO: 1060 - DNA, 20 bp, Artificial Sequence
  Description of Artificial Sequence: Synthetic oligonucleotide
tcatgtcgtctgttcgtccc

SEQ ID NO: 1061 - DNA, 20 bp, Artificial Sequence
  Description of Artificial Sequence: Synthetic oligonucleotide
tttgaagagtggtgggtccg

SEQ ID NO: 1062 - DNA, 20 bp, Artificial Sequence
  Description of Artificial Sequence: Synthetic oligonucleotide
tttggagggggatgggactg

SEQ ID NO: 1063 - DNA, 21 bp, Artificial Sequence
  Description of Artificial Sequence: Synthetic oligonucleotide
tttgaagggtgatgggtgccg

SEQ ID NO: 1064 - DNA, 20 bp, Artificial Sequence
  Description of Artificial Sequence: Synthetic oligonucleotide
atagggagaagggagaaccg

SEQ ID NO: 1065 - DNA, 20 bp, Artificial Sequence
  Description of Artificial Sequence: Synthetic oligonucleotide
tttggaggggggtgggactg

SEQ ID NO: 1066 - DNA, 20 bp, Artificial Sequence
  Description of Artificial Sequence: Synthetic oligonucleotide
tttgaagggggatgtgtccg

SEQ ID NO: 1067 - DNA, 20 bp, Artificial Sequence
  Description of Artificial Sequence: Synthetic oligonucleotide
tttgaagggggaggggtccg

SEQ ID NO: 1068 - DNA, 20 bp, Artificial Sequence
  Description of Artificial Sequence: Synthetic oligonucleotide
ttgggtgtagggggggaccg

SEQ ID NO: 1069 - DNA, 20 bp, Artificial Sequence
  Description of Artificial Sequence: Synthetic oligonucleotide
tattggtggtgtagggaccg

SEQ ID NO: 1070 - DNA, 22 bp, Artificial Sequence
  Description of Artificial Sequence: Synthetic oligonucleotide
tatttgaagggtgatgggtccg

SEQ ID NO: 1071 - DNA, 20 bp, Artificial Sequence
  Description of Artificial Sequence: Synthetic oligonucleotide
attgaagggcgatgggtccg

SEQ ID NO: 1072 - DNA, 20 bp, Artificial Sequence
  Description of Artificial Sequence: Synthetic oligonucleotide
tttgaagggcgatgtgtccg

SEQ ID NO: 1073 - DNA, 20 bp, Artificial Sequence
  Description of Artificial Sequence: Synthetic oligonucleotide
tattggaggtgtagggacca

SEQ ID NO: 1074 - DNA, 20 bp, Artificial Sequence
  Description of Artificial Sequence: Synthetic oligonucleotide
tcctgtcgtctgttcgtgcc

SEQ ID NO: 1075 - DNA, 20 bp, Artificial Sequence
  Description of Artificial Sequence: Synthetic oligonucleotide
ttcgaagggcgatgggtccg

SEQ ID NO: 1076 - DNA, 20 bp, Artificial Sequence
  Description of Artificial Sequence: Synthetic oligonucleotide
tgatttcctcgttgtctgtg

SEQ ID NO: 1077 - DNA, 20 bp, Artificial Sequence
  Description of Artificial Sequence: Synthetic oligonucleotide
tgagtgcctgcgaccgtgtc

SEQ ID NO: 1078 - DNA, 20 bp, Artificial Sequence
  Description of Artificial Sequence: Synthetic oligonucleotide
ccattaggagtagggaggta

SEQ ID NO: 1079 - DNA, 19 bp, Artificial Sequence
  Description of Artificial Sequence: Synthetic oligonucleotide
gttgcagtctgtccgtgtg

SEQ ID NO: 1080 - DNA, 20 bp, Artificial Sequence
  Description of Artificial Sequence: Synthetic oligonucleotide
tcctgtcgtctgttcgtcgc

SEQ ID NO: 1081 - DNA, 20 bp, Artificial Sequence
  Description of Artificial Sequence: Synthetic oligonucleotide
cgtcgtaatggtttgtggtc

SEQ ID NO: 1082 - DNA, 20 bp, Artificial Sequence
  Description of Artificial Sequence: Synthetic oligonucleotide
aatgtcgaaccactgctccc

SEQ ID NO: 1083 - DNA, 20 bp, Artificial Sequence
  Description of Artificial Sequence: Synthetic oligonucleotide
acagtcgtgtctggtttgta

SEQ ID NO: 1084 - DNA, 20 bp, Artificial Sequence
  Description of Artificial Sequence: Synthetic oligonucleotide
cgtttcctctggttcgttcc

SEQ ID NO: 1085 - DNA, 20 bp, Artificial Sequence
  Description of Artificial Sequence: Synthetic oligonucleotide
agagtcgccgtgttcctgtg

SEQ ID NO: 1086 - DNA, 20 bp, Artificial Sequence
  Description of Artificial Sequence: Synthetic oligonucleotide
aaccgtgcggatctcctgtg

SEQ ID NO: 1087 - DNA, 20 bp, Artificial Sequence
  Description of Artificial Sequence: Synthetic oligonucleotide
acatgattaactactgtgcc

SEQ ID NO: 1088 - DNA, 20 bp, Artificial Sequence
  Description of Artificial Sequence: Synthetic oligonucleotide
cagaggagaagggaagttgc

SEQ ID NO: 1089 - DNA, 20 bp, Artificial Sequence
  Description of Artificial Sequence: Synthetic oligonucleotide
tggatcgctggcttatgcgc

SEQ ID NO: 1090 - DNA, 20 bp, Artificial Sequence
  Description of Artificial Sequence: Synthetic oligonucleotide
gcctttccttctgacctccc

SEQ ID NO: 1091 - DNA, 20 bp, Artificial Sequence
  Description of Artificial Sequence: Synthetic oligonucleotide
atcgttaccttctgcctccc

SEQ ID NO: 1092 - DNA, 20 bp, Artificial Sequence
  Description of Artificial Sequence: Synthetic oligonucleotide
caagtcgttcgtaacctgtg

SEQ ID NO: 1093 - DNA, 20 bp, Artificial Sequence
  Description of Artificial Sequence: Synthetic oligonucleotide
caggttgtgtgagtgtgccc

SEQ ID NO: 1094 - DNA, 20 bp, Artificial Sequence
  Description of Artificial Sequence: Synthetic oligonucleotide
acagcacttcacgctgttgc

SEQ ID NO: 1095 - DNA, 20 bp, Artificial Sequence
  Description of Artificial Sequence: Synthetic oligonucleotide
aacccattgtcctcgctgcc

SEQ ID NO: 1096 - DNA, 20 bp, Artificial Sequence
  Description of Artificial Sequence: Synthetic oligonucleotide
aggagaggggttcgtcttcc

SEQ ID NO: 1097 - DNA, 20 bp, Artificial Sequence
  Description of Artificial Sequence: Synthetic oligonucleotide
tttggggttttcccgtgctc

SEQ ID NO: 1098 - DNA, 20 bp, Artificial Sequence
  Description of Artificial Sequence: Synthetic oligonucleotide
tttggggttttcccgtgcct

SEQ ID NO: 1099 - DNA, 20 bp, Artificial Sequence
  Description of Artificial Sequence: Synthetic oligonucleotide
cgtctcctctggttcgtccc

SEQ ID NO: 1100 - DNA, 20 bp, Artificial Sequence
  Description of Artificial Sequence: Synthetic oligonucleotide
ccaatcgtctccgtgttgtg

SEQ ID NO: 1101 - DNA, 20 bp, Artificial Sequence
  Description of Artificial Sequence: Synthetic oligonucleotide
tttggagaagggagggactg

SEQ ID NO: 1102 - DNA, 20 bp, Artificial Sequence
  Description of Artificial Sequence: Synthetic oligonucleotide
tttgattcgtctcctgtgcc

SEQ ID NO: 1103 - DNA, 20 bp, Artificial Sequence
  Description of Artificial Sequence: Synthetic oligonucleotide
tgcgctcctctagttgtctg

SEQ ID NO: 1104 - DNA, 20 bp, Artificial Sequence
  Description of Artificial Sequence: Synthetic oligonucleotide
taaccataaatgatgcgctg

SEQ ID NO: 1105 - DNA, 20 bp, Artificial Sequence
  Description of Artificial Sequence: Synthetic oligonucleotide
cttgaagggtgatgggtccc

SEQ ID NO: 1106 - DNA, 20 bp, Artificial Sequence
  Description of Artificial Sequence: Synthetic oligonucleotide
gttggtgaagggaggtgctg

SEQ ID NO: 1107 - DNA, 20 bp, Artificial Sequence
  Description of Artificial Sequence: Synthetic oligonucleotide
tttgaagggtggtggatccg

SEQ ID NO: 1108 - DNA, 19 bp, Artificial Sequence
  Description of Artificial Sequence: Synthetic oligonucleotide
attgtgaagggaggtaccg

SEQ ID NO: 1109 - DNA, 20 bp, Artificial Sequence
  Description of Artificial Sequence: Synthetic oligonucleotide
attggtgcagggaggtaccg

SEQ ID NO: 1110 - DNA, 20 bp, Artificial Sequence
  Description of Artificial Sequence: Synthetic oligonucleotide
attggagaagggaggcactg

SEQ ID NO: 1111 - DNA, 20 bp, Artificial Sequence
  Description of Artificial Sequence: Synthetic oligonucleotide
tttgaaggatgatgggaccg

SEQ ID NO: 1112 - DNA, 20 bp, Artificial Sequence
  Description of Artificial Sequence: Synthetic oligonucleotide
gccttgcgttctgccctccc

SEQ ID NO: 1113 - DNA, 20 bp, Artificial Sequence
  Description of Artificial Sequence: Synthetic oligonucleotide
gttgaagggagatgggtccg

SEQ ID NO: 1114 - DNA, 20 bp, Artificial Sequence
  Description of Artificial Sequence: Synthetic oligonucleotide
tttgaggggagatgggtccg

SEQ ID NO: 1115 - DNA, 20 bp, Artificial Sequence
  Description of Artificial Sequence: Synthetic oligonucleotide
tttgaagggcgatggttccg

SEQ ID NO: 1116 - DNA, 21 bp, Artificial Sequence
  Description of Artificial Sequence: Synthetic oligonucleotide
ttttgaagggggatgggtccg

SEQ ID NO: 1117 - DNA, 20 bp, Artificial Sequence
  Description of Artificial Sequence: Synthetic oligonucleotide
agagttgtctatgctgcccc

SEQ ID NO: 1118 - DNA, 20 bp, Artificial Sequence
  Description of Artificial Sequence: Synthetic oligonucleotide
cagaggataagggaggttgc

SEQ ID NO: 1119 - DNA, 20 bp, Artificial Sequence
  Description of Artificial Sequence: Synthetic oligonucleotide
atgtcatgtgaatgccgtgc

SEQ ID NO: 1120 - DNA, 20 bp, Artificial Sequence
  Description of Artificial Sequence: Synthetic oligonucleotide
tcttgtcgtctgctcgtccc

SEQ ID NO: 1121 - DNA, 20 bp, Artificial Sequence
  Description of Artificial Sequence: Synthetic oligonucleotide
agagtcctacgcctgttgtg

SEQ ID NO: 1122 - DNA, 20 bp, Artificial Sequence
  Description of Artificial Sequence: Synthetic oligonucleotide
tgtgcgttctccgtgttgtg

SEQ ID NO: 1123 - DNA, 20 bp, Artificial Sequence
  Description of Artificial Sequence: Synthetic oligonucleotide
gttgaagggtgatgggtccc

SEQ ID NO: 1124 - DNA, 20 bp, Artificial Sequence
  Description of Artificial Sequence: Synthetic oligonucleotide
tacaccctggctctcgtctg

SEQ ID NO: 1125 - DNA, 20 bp, Artificial Sequence
  Description of Artificial Sequence: Synthetic oligonucleotide
ctacgtcagtctgctggtgc

SEQ ID NO: 1126 - DNA, 19 bp, Artificial Sequence
  Description of Artificial Sequence: Synthetic oligonucleotide
gcctttcgtgtgccctccc

SEQ ID NO: 1127 - DNA, 20 bp, Artificial Sequence
  Description of Artificial Sequence: Synthetic oligonucleotide
cagagtagaagggaggttgc

SEQ ID NO: 1128 - DNA, 20 bp, Artificial Sequence
  Description of Artificial Sequence: Synthetic oligonucleotide
taagtccgcagtgttggccg

SEQ ID NO: 1129 - DNA, 18 bp, Artificial Sequence
  Description of Artificial Sequence: Synthetic oligonucleotide
gcctcgttctgccctccc

SEQ ID NO: 1130 - DNA, 20 bp, Artificial Sequence
  Description of Artificial Sequence: Synthetic oligonucleotide
gtggccgtcttcgtgttgtg

SEQ ID NO: 1131 - DNA, 20 bp, Artificial Sequence
  Description of Artificial Sequence: Synthetic oligonucleotide
ttgggggtagggtggtactg

SEQ ID NO: 1132 - DNA, 20 bp, Artificial Sequence
  Description of Artificial Sequence: Synthetic oligonucleotide
tacgtcttcctgtgcctccc

SEQ ID NO: 1133 - DNA, 19 bp, Artificial Sequence
  Description of Artificial Sequence: Synthetic oligonucleotide
attttggagaagggaggtg

SEQ ID NO: 1134 - DNA, 20 bp, Artificial Sequence
  Description of Artificial Sequence: Synthetic oligonucleotide
ctagttgcatgccacctgtg

SEQ ID NO: 1135 - DNA, 20 bp, Artificial Sequence
  Description of Artificial Sequence: Synthetic oligonucleotide
attggtgaagggaggtatcg

SEQ ID NO: 1136 - DNA, 20 bp, Artificial Sequence
  Description of Artificial Sequence: Synthetic oligonucleotide
atgggtgtagggaggtaccg

SEQ ID NO: 1137 - DNA, 20 bp, Artificial Sequence
  Description of Artificial Sequence: Synthetic oligonucleotide
tttgaagggggaagggtccg

SEQ ID NO: 1138 - DNA, 20 bp, Artificial Sequence
  Description of Artificial Sequence: Synthetic oligonucleotide
attggtgaagggaggtcccg

SEQ ID NO: 1139 - DNA, 20 bp, Artificial Sequence
  Description of Artificial Sequence: Synthetic oligonucleotide
tttgaaggtcgatgggtccg

SEQ ID NO: 1140 - DNA, 20 bp, Artificial Sequence
  Description of Artificial Sequence: Synthetic oligonucleotide
tccacctcgtattcgtgccc

SEQ ID NO: 1141 - DNA, 20 bp, Artificial Sequence
  Description of Artificial Sequence: Synthetic oligonucleotide
gcctttcgtactgacctccc

SEQ ID NO: 1142 - DNA, 20 bp, Artificial Sequence
  Description of Artificial Sequence: Synthetic oligonucleotide
tcctggcgtctgttcgtccc

SEQ ID NO: 1143 - DNA, 20 bp, Artificial Sequence
  Description of Artificial Sequence: Synthetic oligonucleotide
tccgcacaacgttcctgccc

SEQ ID NO: 1144 - DNA, 20 bp, Artificial Sequence
  Description of Artificial Sequence: Synthetic oligonucleotide
tttgaagggggctgggtccg

SEQ ID NO: 1145 - DNA, 20 bp, Artificial Sequence
  Description of Artificial Sequence: Synthetic oligonucleotide
tttgaagggatatgggtccg

SEQ ID NO: 1146 - DNA, 20 bp, Artificial Sequence
  Description of Artificial Sequence: Synthetic oligonucleotide
tttgagaggtgatgggtccg

SEQ ID NO: 1147 - DNA, 20 bp, Artificial Sequence
  Description of Artificial Sequence: Synthetic oligonucleotide
ttggaaggggggtgggaccg

SEQ ID NO: 1148 - DNA, 19 bp, Artificial Sequence
  Description of Artificial Sequence: Synthetic oligonucleotide
ttgaagggagatgggtccg

SEQ ID NO: 1149 - DNA, 20 bp, Artificial Sequence
  Description of Artificial Sequence: Synthetic oligonucleotide
ttggaaggagggtgggaccg

SEQ ID NO: 1150 - DNA, 20 bp, Artificial Sequence
  Description of Artificial Sequence: Synthetic oligonucleotide
tattggaggtgtaaggaccg

SEQ ID NO: 1151 - DNA, 20 bp, Artificial Sequence
  Description of Artificial Sequence: Synthetic oligonucleotide
ccctttcgttctcacctccc

SEQ ID NO: 1152 - DNA, 20 bp, Artificial Sequence
  Description of Artificial Sequence: Synthetic oligonucleotide
tttgaaaggtggtgggtccg

SEQ ID NO: 1153 - DNA, 20 bp, Artificial Sequence
  Description of Artificial Sequence: Synthetic oligonucleotide
gttgggtgtagggagttccg

SEQ ID NO: 1154 - DNA, 20 bp, Artificial Sequence
  Description of Artificial Sequence: Synthetic oligonucleotide
tttgaatggtggtgggtccg

SEQ ID NO: 1155 - DNA, 20 bp, Artificial Sequence
  Description of Artificial Sequence: Synthetic oligonucleotide
ttggaagtagggtggtaccg

SEQ ID NO: 1156 - DNA, 20 bp, Artificial Sequence
  Description of Artificial Sequence: Synthetic oligonucleotide
gttgtagggtgatgggtccg

SEQ ID NO: 1157 - DNA, 20 bp, Artificial Sequence
  Description of Artificial Sequence: Synthetic oligonucleotide
tgtaggaggagtaggtaccg

SEQ ID NO: 1158 - DNA, 20 bp, Artificial Sequence
  Description of Artificial Sequence: Synthetic oligonucleotide
attggtgaacggaggtactg

SEQ ID NO: 1159 - DNA, 20 bp, Artificial Sequence
  Description of Artificial Sequence: Synthetic oligonucleotide
agagcgagaatctggtgcac

SEQ ID NO: 1160 - DNA, 20 bp, Artificial Sequence
  Description of Artificial Sequence: Synthetic oligonucleotide
aatagtccttgccttgtgcc

SEQ ID NO: 1161 - DNA, 20 bp, Artificial Sequence
  Description of Artificial Sequence: Synthetic oligonucleotide
tgatcttctgggtaccaccc

SEQ ID NO: 1162 - DNA, 20 bp, Artificial Sequence
  Description of Artificial Sequence: Synthetic oligonucleotide
tgtagtgggtacgtcgtgtg

SEQ ID NO: 1163 - DNA, 20 bp, Artificial Sequence
  Description of Artificial Sequence: Synthetic oligonucleotide
caccttatctttggtgaccc

SEQ ID NO: 1164 - DNA, 20 bp, Artificial Sequence
  Description of Artificial Sequence: Synthetic oligonucleotide
acgacagtcctctgcgcgtg

SEQ ID NO: 1165 - DNA, 20 bp, Artificial Sequence
  Description of Artificial Sequence: Synthetic oligonucleotide
tgtgatcgtctgttcctcca

SEQ ID NO: 1166 - DNA, 20 bp, Artificial Sequence
  Description of Artificial Sequence: Synthetic oligonucleotide
ttagagtatgttgggtgctg

SEQ ID NO: 1167 - DNA, 20 bp, Artificial Sequence
  Description of Artificial Sequence: Synthetic oligonucleotide
ttcgggccatcctgcgtgtg

SEQ ID NO: 1168 - DNA, 20 bp, Artificial Sequence
  Description of Artificial Sequence: Synthetic oligonucleotide
ctctgatggaggagggtgga

SEQ ID NO: 1169 - DNA, 20 bp, Artificial Sequence
  Description of Artificial Sequence: Synthetic oligonucleotide
tgagttcgtactgtcggccc

SEQ ID NO: 1170 - DNA, 20 bp, Artificial Sequence
  Description of Artificial Sequence: Synthetic oligonucleotide
tcgttcctgtcgtcgtggtg

SEQ ID NO: 1171 - DNA, 20 bp, Artificial Sequence
  Description of Artificial Sequence: Synthetic oligonucleotide
catcagtatactccccactg

SEQ ID NO: 1172 - DNA, 20 bp, Artificial Sequence
  Description of Artificial Sequence: Synthetic oligonucleotide
tccgtcatgtcgttatgctg

SEQ ID NO: 1173 - DNA, 20 bp, Artificial Sequence
  Description of Artificial Sequence: Synthetic oligonucleotide
tccctctgtcgtgtgctgtc

SEQ ID NO: 1174 - DNA, 20 bp, Artificial Sequence
  Description of Artificial Sequence: Synthetic oligonucleotide
aacagtcactggcttgccgc

SEQ ID NO: 1175 - DNA, 20 bp, Artificial Sequence
  Description of Artificial Sequence: Synthetic oligonucleotide
cagaaggccaactgcatgtg

SEQ ID NO: 1176 - DNA, 20 bp, Artificial Sequence
  Description of Artificial Sequence: Synthetic oligonucleotide
gttagtctatgcgcggtgcc

SEQ ID NO: 1177 - DNA, 20 bp, Artificial Sequence
  Description of Artificial Sequence: Synthetic oligonucleotide
gactgtccttcgtcgtggtg

SEQ ID NO: 1178 - DNA, 20 bp, Artificial Sequence
  Description of Artificial Sequence: Synthetic oligonucleotide
tccttccgtcgtttgtgccc

SEQ ID NO: 1179 - DNA, 20 bp, Artificial Sequence
  Description of Artificial Sequence: Synthetic oligonucleotide
ttgggcgtagggtggtactg

SEQ ID NO: 1180 - DNA, 19 bp, Artificial Sequence
  Description of Artificial Sequence: Synthetic oligonucleotide
tgcgacactattttggctg

SEQ ID NO: 1181 - DNA, 20 bp, Artificial Sequence
  Description of Artificial Sequence: Synthetic oligonucleotide
tttcgtctcccctacgtgcc

SEQ ID NO: 1182 - DNA, 20 bp, Artificial Sequence
  Description of Artificial Sequence: Synthetic oligonucleotide
accgacacgtcttccatggc

SEQ ID NO: 1183 - DNA, 20 bp, Artificial Sequence
  Description of Artificial Sequence: Synthetic oligonucleotide
tctaggaggaggaggtaccg

SEQ ID NO: 1184 - DNA, 20 bp, Artificial Sequence
  Description of Artificial Sequence: Synthetic oligonucleotide
tcacagatcctccttgtggc

SEQ ID NO: 1185 - DNA, 20 bp, Artificial Sequence
  Description of Artificial Sequence: Synthetic oligonucleotide
tttgaagggagacgggtccg

SEQ ID NO: 1186 - DNA, 20 bp, Artificial Sequence
  Description of Artificial Sequence: Synthetic oligonucleotide
taggtcgctgcgccgttgtg

SEQ ID NO: 1187 - DNA, 19 bp, Artificial Sequence
  Description of Artificial Sequence: Synthetic oligonucleotide
aggcccatgtcgtcgtgtg

SEQ ID NO: 1188 - DNA, 19 bp, Artificial Sequence
  Description of Artificial Sequence: Synthetic oligonucleotide
ttggagggtgatgggtccg

SEQ ID NO: 1189 - DNA, 20 bp, Artificial Sequence
  Description of Artificial Sequence: Synthetic oligonucleotide
ttgggagggggatgggtccg

SEQ ID NO: 1190 - DNA, 20 bp, Artificial Sequence
  Description of Artificial Sequence: Synthetic oligonucleotide
tcctgtcgtctgttggtccc

SEQ ID NO: 1191 - DNA, 20 bp, Artificial Sequence
  Description of Artificial Sequence: Synthetic oligonucleotide
aacctcatcttaacgtgccc

SEQ ID NO: 1192 - DNA, 20 bp, Artificial Sequence
  Description of Artificial Sequence: Synthetic oligonucleotide
tatcccaaaatgccccaccg

SEQ ID NO: 1193 - DNA, 20 bp, Artificial Sequence
  Description of Artificial Sequence: Synthetic oligonucleotide
tgtcgaacggtgtttatcgc

SEQ ID NO: 1194 - DNA, 20 bp, Artificial Sequence
  Description of Artificial Sequence: Synthetic oligonucleotide
tttgaagggagaagggtccg

SEQ ID NO: 1195 - DNA, 20 bp, Artificial Sequence
  Description of Artificial Sequence: Synthetic oligonucleotide
tcttctcggcgctcgttgtg

SEQ ID NO: 1196 - DNA, 20 bp, Artificial Sequence
  Description of Artificial Sequence: Synthetic oligonucleotide
tttgaatgggggtgtagggt

SEQ ID NO: 1197 - DNA, 20 bp, Artificial Sequence
  Description of Artificial Sequence: Synthetic oligonucleotide
tttgaagggtgaagggaccg

SEQ ID NO: 1198 - DNA, 20 bp, Artificial Sequence
  Description of Artificial Sequence: Synthetic oligonucleotide
tttggggggtgatgggtccg

SEQ ID NO: 1199 - DNA, 20 bp, Artificial Sequence
  Description of Artificial Sequence: Synthetic oligonucleotide
tattggaggtgtatggaccg

SEQ ID NO: 1200 - DNA, 20 bp, Artificial Sequence
  Description of Artificial Sequence: Synthetic oligonucleotide
tgtaggaggaggaggtacct

SEQ ID NO: 1201 - DNA, 20 bp, Artificial Sequence
  Description of Artificial Sequence: Synthetic oligonucleotide
gtcctgtcgtctttcgtccc

SEQ ID NO: 1202 - DNA, 20 bp, Artificial Sequence
  Description of Artificial Sequence: Synthetic oligonucleotide
attggtgaagggatgtaccg

SEQ ID NO: 1203 - DNA, 20 bp, Artificial Sequence
  Description of Artificial Sequence: Synthetic oligonucleotide
tttgaagggagatggatccg

SEQ ID NO: 1204 - DNA, 20 bp, Artificial Sequence
  Description of Artificial Sequence: Synthetic oligonucleotide
agtgagctcgtctatggccc

SEQ ID NO: 1205 - DNA, 20 bp, Artificial Sequence
  Description of Artificial Sequence: Synthetic oligonucleotide
attggaggagggtgggactg

SEQ ID NO: 1206 - DNA, 20 bp, Artificial Sequence
  Description of Artificial Sequence: Synthetic oligonucleotide
tttgaatggggatgggtccg

SEQ ID NO: 1207 - DNA, 20 bp, Artificial Sequence
  Description of Artificial Sequence: Synthetic oligonucleotide
tttggagtggggtgggaccg

SEQ ID NO: 1208 - DNA, 20 bp, Artificial Sequence
  Description of Artificial Sequence: Synthetic oligonucleotide
tttgaagggtgctgggcccg

SEQ ID NO: 1209 - DNA, 20 bp, Artificial Sequence
  Description of Artificial Sequence: Synthetic oligonucleotide
ttgggaggaggatggtaccg

SEQ ID NO: 1210 - DNA, 20 bp, Artificial Sequence
  Description of Artificial Sequence: Synthetic oligonucleotide
ccacgttgtctgcgactgtg

SEQ ID NO: 1211 - DNA, 20 bp, Artificial Sequence
  Description of Artificial Sequence: Synthetic oligonucleotide
tagctttaccctgcaagcta

SEQ ID NO: 1212 - DNA, 20 bp, Artificial Sequence
  Description of Artificial Sequence: Synthetic oligonucleotide
cataatactcctgtcgtgta

SEQ ID NO: 1213 - DNA, 20 bp, Artificial Sequence
  Description of Artificial Sequence: Synthetic oligonucleotide
gtgctgtcgatcttcgtccc

SEQ ID NO: 1214 - DNA, 20 bp, Artificial Sequence
  Description of Artificial Sequence: Synthetic oligonucleotide
catcgttttcgtcgcgttac

SEQ ID NO: 1215 - DNA, 19 bp, Artificial Sequence
  Description of Artificial Sequence: Synthetic oligonucleotide
gcctttcgttcgccctccc

SEQ ID NO: 1216 - DNA, 20 bp, Artificial Sequence
  Description of Artificial Sequence: Synthetic oligonucleotide
tcttcacctgccgtcgtgtg

SEQ ID NO: 1217 - DNA, 20 bp, Artificial Sequence
  Description of Artificial Sequence: Synthetic oligonucleotide
tttgaagggtgatggctccc

SEQ ID NO: 1218 - DNA, 20 bp, Artificial Sequence
  Description of Artificial Sequence: Synthetic oligonucleotide
atcgatctaatcccggtcgc

SEQ ID NO: 1219 - DNA, 20 bp, Artificial Sequence
  Description of Artificial Sequence: Synthetic oligonucleotide
tcctgttcctctcgtgtcgg

SEQ ID NO: 1220 - DNA, 20 bp, Artificial Sequence
  Description of Artificial Sequence: Synthetic oligonucleotide
cattgtcttatgtcgtgtgc

SEQ ID NO: 1221 - DNA, 20 bp, Artificial Sequence
  Description of Artificial Sequence: Synthetic oligonucleotide
tcccctgattgtcgtttgtg

SEQ ID NO: 1222 - DNA, 20 bp, Artificial Sequence
  Description of Artificial Sequence: Synthetic oligonucleotide
gcctttcgttctctcctccc

SEQ ID NO: 1223 - DNA, 20 bp, Artificial Sequence
  Description of Artificial Sequence: Synthetic oligonucleotide
tgtccttcattaggccgcac

SEQ ID NO: 1224 - DNA, 20 bp, Artificial Sequence
  Description of Artificial Sequence: Synthetic oligonucleotide
tctggttctcctgctcgctg

SEQ ID NO: 1225 - DNA, 20 bp, Artificial Sequence
  Description of Artificial Sequence: Synthetic oligonucleotide
aaagtcggctctggtgtgcc

SEQ ID NO: 1226 - DNA, 20 bp, Artificial Sequence
  Description of Artificial Sequence: Synthetic oligonucleotide
acaccattacttcgccaccc

SEQ ID NO: 1227 - DNA, 20 bp, Artificial Sequence
  Description of Artificial Sequence: Synthetic oligonucleotide
tcctgtgtctccacgtactg

SEQ ID NO: 1228 - DNA, 20 bp, Artificial Sequence
  Description of Artificial Sequence: Synthetic oligonucleotide
tgagtcgtaatttgccgcgt

SEQ ID NO: 1229 - DNA, 18 bp, Artificial Sequence
  Description of Artificial Sequence: Synthetic oligonucleotide
attggtagggaggtactg

SEQ ID NO: 1230 - DNA, 20 bp, Artificial Sequence
  Description of Artificial Sequence: Synthetic oligonucleotide
tgagtacctccgttcgtgtc

SEQ ID NO: 1231 - DNA, 20 bp, Artificial Sequence
  Description of Artificial Sequence: Synthetic oligonucleotide
tccccatgtgtcttctgtgc

SEQ ID NO: 1232 - DNA, 19 bp, Artificial Sequence
  Description of Artificial Sequence: Synthetic oligonucleotide
taaagtgcgggttcgtgtc

SEQ ID NO: 1233 - DNA, 20 bp, Artificial Sequence
  Description of Artificial Sequence: Synthetic oligonucleotide
ttagtcgtgttctgtcgctg

SEQ ID NO: 1234 - DNA, 20 bp, Artificial Sequence
  Description of Artificial Sequence: Synthetic oligonucleotide
cgcttcctctggttcgtccc

SEQ ID NO: 1235 - DNA, 20 bp, Artificial Sequence
  Description of Artificial Sequence: Synthetic oligonucleotide
tgagtctgacgactgtgcgc

SEQ ID NO: 1236 - DNA, 20 bp, Artificial Sequence
  Description of Artificial Sequence: Synthetic oligonucleotide
attgacctctatcccgtgcc

SEQ ID NO: 1237 - DNA, 20 bp, Artificial Sequence
  Description of Artificial Sequence: Synthetic oligonucleotide
cccgtccttcctcgtttgcc

SEQ ID NO: 1238 - DNA, 20 bp, Artificial Sequence
  Description of Artificial Sequence: Synthetic oligonucleotide
tctgaagggcgatgggtccg

SEQ ID NO: 1239 - DNA, 18 bp, Artificial Sequence
  Description of Artificial Sequence: Synthetic oligonucleotide
tttgaagggtgatctccg

SEQ ID NO: 1240 - DNA, 20 bp, Artificial Sequence
  Description of Artificial Sequence: Synthetic oligonucleotide
tttgatgggagatgggtccg

SEQ ID NO: 1241 - DNA, 19 bp, Artificial Sequence
  Description of Artificial Sequence: Synthetic oligonucleotide
tgtgtagtctatccgcccg

SEQ ID NO: 1242 - DNA, 20 bp, Artificial Sequence
  Description of Artificial Sequence: Synthetic oligonucleotide
tttgaagtgggatgggaccg

SEQ ID NO: 1243 - DNA, 20 bp, Artificial Sequence
  Description of Artificial Sequence: Synthetic oligonucleotide
gcctttcgtgctgacctccc

SEQ ID NO: 1244 - DNA, 20 bp, Artificial Sequence
  Description of Artificial Sequence: Synthetic oligonucleotide
cattgtctcccgtcggtgtg

SEQ ID NO: 1245 - DNA, 20 bp, Artificial Sequence
  Description of Artificial Sequence: Synthetic oligonucleotide
tcctgtcgtctgtacgtccc

SEQ ID NO: 1246 - DNA, 20 bp, Artificial Sequence
  Description of Artificial Sequence: Synthetic oligonucleotide
atgggttgtcttaccggtgc

SEQ ID NO: 1247 - DNA, 20 bp, Artificial Sequence
  Description of Artificial Sequence: Synthetic oligonucleotide
gtcctgtgtctgttcgtccc

SEQ ID NO: 1248 - DNA, 20 bp, Artificial Sequence
  Description of Artificial Sequence: Synthetic oligonucleotide
tttgaagtgagatgggtccg

SEQ ID NO: 1249 - DNA, 20 bp, Artificial Sequence
  Description of Artificial Sequence: Synthetic oligonucleotide
tttgaagggaaatgggtccg

SEQ ID NO: 1250 - DNA, 20 bp, Artificial Sequence
  Description of Artificial Sequence: Synthetic oligonucleotide
atagggggaagggtgaaccg

SEQ ID NO: 1251 - DNA, 20 bp, Artificial Sequence
  Description of Artificial Sequence: Synthetic oligonucleotide
tgtatgaggaggaggtaccg

SEQ ID NO: 1252 - DNA, 19 bp, Artificial Sequence
  Description of Artificial Sequence: Synthetic oligonucleotide
ttgggtgtagggtggaccg

SEQ ID NO: 1253 - DNA, 19 bp, Artificial Sequence
  Description of Artificial Sequence: Synthetic oligonucleotide
gtgggtgtagggtgtaccg

SEQ ID NO: 1254 - DNA, 20 bp, Artificial Sequence
  Description of Artificial Sequence: Synthetic oligonucleotide
tttgaagggagatgagtccg

SEQ ID NO: 1255 - DNA, 20 bp, Artificial Sequence
  Description of Artificial Sequence: Synthetic oligonucleotide
tttgaagggcgatggatccg

SEQ ID NO: 1256 - DNA, 19 bp, Artificial Sequence
  Description of Artificial Sequence: Synthetic oligonucleotide
ttgaagggggatgggtccg

SEQ ID NO: 1257 - DNA, 20 bp, Artificial Sequence
  Description of Artificial Sequence: Synthetic oligonucleotide
tttggaggagggtgggtccg

SEQ ID NO: 1258 - DNA, 20 bp, Artificial Sequence
  Description of Artificial Sequence: Synthetic oligonucleotide
tgtagggaggtagttatcgc

SEQ ID NO: 1259 - DNA, 20 bp, Artificial Sequence
  Description of Artificial Sequence: Synthetic oligonucleotide
gtcgtttgttaagtggccgc

SEQ ID NO: 1260 - DNA, 20 bp, Artificial Sequence
  Description of Artificial Sequence: Synthetic oligonucleotide
tatcgtcagttctcctgcgc

SEQ ID NO: 1261 - DNA, 20 bp, Artificial Sequence
  Description of Artificial Sequence: Synthetic oligonucleotide
tgagtttgtttagctggccc

SEQ ID NO: 1262 - DNA, 20 bp, Artificial Sequence
  Description of Artificial Sequence: Synthetic oligonucleotide
ctttcgtctcctgtcgtgca

SEQ ID NO: 1263 - DNA, 20 bp, Artificial Sequence
  Description of Artificial Sequence: Synthetic oligonucleotide
tagtcctatgtcgtatgctg

SEQ ID NO: 1264 - DNA, 20 bp, Artificial Sequence
  Description of Artificial Sequence: Synthetic oligonucleotide
tatgggagtagggtggcacg

SEQ ID NO: 1265 - DNA, 20 bp, Artificial Sequence
  Description of Artificial Sequence: Synthetic oligonucleotide
cgtttcctctggttcgtcgc

SEQ ID NO: 1266 - DNA, 19 bp, Artificial Sequence
  Description of Artificial Sequence: Synthetic oligonucleotide
gttggttcgtctccgtgta

SEQ ID NO: 1267 - DNA, 20 bp, Artificial Sequence
  Description of Artificial Sequence: Synthetic oligonucleotide
tctttctcctcctgtcgctg

SEQ ID NO: 1268 - DNA, 20 bp, Artificial Sequence
  Description of Artificial Sequence: Synthetic oligonucleotide
gaacaacttacttccctggc

SEQ ID NO: 1269 - DNA, 20 bp, Artificial Sequence
  Description of Artificial Sequence: Synthetic oligonucleotide
taggtctggtgcagtgtgtg

SEQ ID NO: 1270 - DNA, 20 bp, Artificial Sequence
  Description of Artificial Sequence: Synthetic oligonucleotide
ccgcattgttcgtctgtgtc

SEQ ID NO: 1271 - DNA, 20 bp, Artificial Sequence
  Description of Artificial Sequence: Synthetic oligonucleotide
tgcgaactctggggtctgtg

SEQ ID NO: 1272 - DNA, 20 bp, Artificial Sequence
  Description of Artificial Sequence: Synthetic oligonucleotide
caccctttatactgcaaggg

SEQ ID NO: 1273 - DNA, 18 bp, Artificial Sequence
  Description of Artificial Sequence: Synthetic oligonucleotide
ttgtgtagggtggtaccg

SEQ ID NO: 1274 - DNA, 20 bp, Artificial Sequence
  Description of Artificial Sequence: Synthetic oligonucleotide
tactttatcctgcaagtgac

SEQ ID NO: 1275 - DNA, 19 bp, Artificial Sequence
  Description of Artificial Sequence: Synthetic oligonucleotide
gcctttcgttctgccttcc

SEQ ID NO: 1276 - DNA, 20 bp, Artificial Sequence
  Description of Artificial Sequence: Synthetic oligonucleotide
tagagtcggactctggtcgc

SEQ ID NO: 1277 - DNA, 20 bp, Artificial Sequence
  Description of Artificial Sequence: Synthetic oligonucleotide
cattgtcccgacattatccg

SEQ ID NO: 1278 - DNA, 20 bp, Artificial Sequence
  Description of Artificial Sequence: Synthetic oligonucleotide
atgggttcgctgcagttgtg

SEQ ID NO: 1279 - DNA, 20 bp, Artificial Sequence
  Description of Artificial Sequence: Synthetic oligonucleotide
ttgggtgtaaagtggtaccg

SEQ ID NO: 1280 - DNA, 20 bp, Artificial Sequence
  Description of Artificial Sequence: Synthetic oligonucleotide
acgggttaacctggttacgc

SEQ ID NO: 1281 - DNA, 20 bp, Artificial Sequence
  Description of Artificial Sequence: Synthetic oligonucleotide
agagactacggattcgcgtg

SEQ ID NO: 1282 - DNA, 20 bp, Artificial Sequence
  Description of Artificial Sequence: Synthetic oligonucleotide
gtgtagtgaatgtgtggccc

SEQ ID NO: 1283 - DNA, 20 bp, Artificial Sequence
  Description of Artificial Sequence: Synthetic oligonucleotide
tgcgaagggtgatgggtccg

SEQ ID NO: 1284 - DNA, 20 bp, Artificial Sequence
  Description of Artificial Sequence: Synthetic oligonucleotide
ttagtcctatcgtttggcac

SEQ ID NO: 1285 - DNA, 20 bp, Artificial Sequence
  Description of Artificial Sequence: Synthetic oligonucleotide
tgaggtatgctctgcgtgtg

SEQ ID NO: 1286 - DNA, 20 bp, Artificial Sequence
  Description of Artificial Sequence: Synthetic oligonucleotide
acatgtcgttcgccttggtg

SEQ ID NO: 1287 - DNA, 20 bp, Artificial Sequence
  Description of Artificial Sequence: Synthetic oligonucleotide
gcctttcggtttgccctccc

SEQ ID NO: 1288 - DNA, 21 bp, Artificial Sequence
  Description of Artificial Sequence: Synthetic oligonucleotide
gtcctatcgtctgttcgtccc

SEQ ID NO: 1289 - DNA, 20 bp, Artificial Sequence
  Description of Artificial Sequence: Synthetic oligonucleotide
tcccgtcgttgcgatttcgc

SEQ ID NO: 1290 - DNA, 20 bp, Artificial Sequence
  Description of Artificial Sequence: Synthetic oligonucleotide
aaattcgtctccccgttgtg

SEQ ID NO: 1291 - DNA, 20 bp, Artificial Sequence
  Description of Artificial Sequence: Synthetic oligonucleotide
actgtgtatagacactggcc

SEQ ID NO: 1292 - DNA, 20 bp, Artificial Sequence
  Description of Artificial Sequence: Synthetic oligonucleotide
tattggaggtggagggaccg

SEQ ID NO: 1293 - DNA, 21 bp, Artificial Sequence
  Description of Artificial Sequence: Synthetic oligonucleotide
attggtgaaagggaggtactg

SEQ ID NO: 1294 - DNA, 21 bp, Artificial Sequence
  Description of Artificial Sequence: Synthetic oligonucleotide
atttggtgaagggaggtactg

SEQ ID NO: 1295 - DNA, 20 bp, Artificial Sequence
  Description of Artificial Sequence: Synthetic oligonucleotide
attggtgaagggaggtacct

SEQ ID NO: 1296 - DNA, 20 bp, Artificial Sequence
  Description of Artificial Sequence: Synthetic oligonucleotide
tgagtgtctgctttccaccc

SEQ ID NO: 1297 - DNA, 20 bp, Artificial Sequence
  Description of Artificial Sequence: Synthetic oligonucleotide
gtggagactacatgtggcgc

SEQ ID NO: 1298 - DNA, 20 bp, Artificial Sequence
  Description of Artificial Sequence: Synthetic oligonucleotide
taatgcagtgtttcgtgccc

SEQ ID NO: 1299 - DNA, 20 bp, Artificial Sequence
  Description of Artificial Sequence: Synthetic oligonucleotide
tgtcacttttcacgtggctg

SEQ ID NO: 1300 - DNA, 20 bp, Artificial Sequence
  Description of Artificial Sequence: Synthetic oligonucleotide
tccttcactgattcgctgtg

SEQ ID NO: 1301 - DNA, 20 bp, Artificial Sequence
  Description of Artificial Sequence: Synthetic oligonucleotide
aagcctccgtgtttgcgcgc

SEQ ID NO: 1302 - DNA, 20 bp, Artificial Sequence
  Description of Artificial Sequence: Synthetic oligonucleotide
tttgaagtgtggtgggtccg

SEQ ID NO: 1303 - DNA, 20 bp, Artificial Sequence
  Description of Artificial Sequence: Synthetic oligonucleotide
tttgaagggggatgggtccc

SEQ ID NO: 1304 - DNA, 20 bp, Artificial Sequence
  Description of Artificial Sequence: Synthetic oligonucleotide
tgtagggaggcagttatcgt

SEQ ID NO: 1305 - DNA, 20 bp, Artificial Sequence
  Description of Artificial Sequence: Synthetic oligonucleotide
ttgggtggaggggggtaccg

SEQ ID NO: 1306 - DNA, 18 bp, Artificial Sequence
  Description of Artificial Sequence: Synthetic oligonucleotide
gcctcgttctgacctccc

SEQ ID NO: 1307 - DNA, 20 bp, Artificial Sequence
  Description of Artificial Sequence: Synthetic oligonucleotide
aaccgaggtccttcgtaccc

SEQ ID NO: 1308 - DNA, 20 bp, Artificial Sequence
  Description of Artificial Sequence: Synthetic oligonucleotide
tccgcggtttgtcacctcac

SEQ ID NO: 1309 - DNA, 20 bp, Artificial Sequence
  Description of Artificial Sequence: Synthetic oligonucleotide
gtgacttccctggttctcgc

SEQ ID NO: 1310 - DNA, 20 bp, Artificial Sequence
  Description of Artificial Sequence: Synthetic oligonucleotide
tgtccaatgaatgtctgccc

SEQ ID NO: 1311 - DNA, 20 bp, Artificial Sequence
  Description of Artificial Sequence: Synthetic oligonucleotide
attgaagggggatgggaccg

SEQ ID NO: 1312 - DNA, 20 bp, Artificial Sequence
  Description of Artificial Sequence: Synthetic oligonucleotide
tttgaagggttgtgggtccg

SEQ ID NO: 1313 - DNA, 20 bp, Artificial Sequence
  Description of Artificial Sequence: Synthetic oligonucleotide
tttggagggggatgggtctg

SEQ ID NO: 1314 - DNA, 20 bp, Artificial Sequence
  Description of Artificial Sequence: Synthetic oligonucleotide
tttggagaagggaggtactg

SEQ ID NO: 1315 - DNA, 20 bp, Artificial Sequence
  Description of Artificial Sequence: Synthetic oligonucleotide
ttttaagggtggtgggtccg

SEQ ID NO: 1316 - DNA, 20 bp, Artificial Sequence
  Description of Artificial Sequence: Synthetic oligonucleotide
ttgggaggggggtggtaccg

SEQ ID NO: 1317 - DNA, 20 bp, Artificial Sequence
  Description of Artificial Sequence: Synthetic oligonucleotide
tgtaggaggatgaggtaccg

SEQ ID NO: 1318 - DNA, 20 bp, Artificial Sequence
  Description of Artificial Sequence: Synthetic oligonucleotide
tttgaagagggatgggaccg

SEQ ID NO: 1319 - DNA, 20 bp, Artificial Sequence
  Description of Artificial Sequence: Synthetic oligonucleotide
tttgaagggagatgggtacg

SEQ ID NO: 1320 - DNA, 20 bp, Artificial Sequence
  Description of Artificial Sequence: Synthetic oligonucleotide
acaggtcgttctgactccac

SEQ ID NO: 1321 - DNA, 20 bp, Artificial Sequence
  Description of Artificial Sequence: Synthetic oligonucleotide
tcgagtcctcatctgtgctg

SEQ ID NO: 1322 - DNA, 20 bp, Artificial Sequence
  Description of Artificial Sequence: Synthetic oligonucleotide
gtcttctgtcttatcgtccc

SEQ ID NO: 1323 - DNA, 20 bp, Artificial Sequence
  Description of Artificial Sequence: Synthetic oligonucleotide
catcgatccgtctacgtgtg

SEQ ID NO: 1324 - DNA, 20 bp, Artificial Sequence
  Description of Artificial Sequence: Synthetic oligonucleotide
ttagtgtacaatccctgccc

SEQ ID NO: 1325 - DNA, 20 bp, Artificial Sequence
  Description of Artificial Sequence: Synthetic oligonucleotide
gtagacgtccgcgcgttgtg

SEQ ID NO: 1326 - DNA, 20 bp, Artificial Sequence
  Description of Artificial Sequence: Synthetic oligonucleotide
tctctctcgtcgtcactgtg

SEQ ID NO: 1327 - DNA, 20 bp, Artificial Sequence
  Description of Artificial Sequence: Synthetic oligonucleotide
gttgactcgtctcctctccc

SEQ ID NO: 1328 - DNA, 20 bp, Artificial Sequence
  Description of Artificial Sequence: Synthetic oligonucleotide
gatcgtactttccccgtgcc

SEQ ID NO: 1329 - DNA, 20 bp, Artificial Sequence
  Description of Artificial Sequence: Synthetic oligonucleotide
atccacatcctctttgtccg

SEQ ID NO: 1330 - DNA, 20 bp, Artificial Sequence
  Description of Artificial Sequence: Synthetic oligonucleotide
ttttcctttgtcgctggcgc

SEQ ID NO: 1331 - DNA, 20 bp, Artificial Sequence
  Description of Artificial Sequence: Synthetic oligonucleotide
ttcctcaaatgtcgtgtgtg

SEQ ID NO: 1332 - DNA, 20 bp, Artificial Sequence
  Description of Artificial Sequence: Synthetic oligonucleotide
tgccgttagatcgcctaccc

SEQ ID NO: 1333 - DNA, 20 bp, Artificial Sequence
  Description of Artificial Sequence: Synthetic oligonucleotide
cacccttcatgttgcctgcc

SEQ ID NO: 1334 - DNA, 20 bp, Artificial Sequence
  Description of Artificial Sequence: Synthetic oligonucleotide
tgattcgtctcatacgtggc

SEQ ID NO: 1335 - DNA, 20 bp, Artificial Sequence
  Description of Artificial Sequence: Synthetic oligonucleotide
acagaagtcgtcattgcccc

SEQ ID NO: 1336 - DNA, 20 bp, Artificial Sequence
  Description of Artificial Sequence: Synthetic oligonucleotide
aaggccctcgtcgtctgctg

SEQ ID NO: 1337 - DNA, 20 bp, Artificial Sequence
  Description of Artificial Sequence: Synthetic oligonucleotide
ctagttccttctcgtgtggc

SEQ ID NO: 1338 - DNA, 20 bp, Artificial Sequence
  Description of Artificial Sequence: Synthetic oligonucleotide
caaagtcatcctcgcgtgtg

SEQ ID NO: 1339 - DNA, 21 bp, Artificial Sequence
  Description of Artificial Sequence: Synthetic oligonucleotide
ggcctttcgttctgccctccc

SEQ ID NO: 1340 - DNA, 20 bp, Artificial Sequence
  Description of Artificial Sequence: Synthetic oligonucleotide
ctgggtgtagggtggtactg

SEQ ID NO: 1341 - DNA, 20 bp, Artificial Sequence
  Description of Artificial Sequence: Synthetic oligonucleotide
tcgctcgttatgtcgttgca

SEQ ID NO: 1342 - DNA, 20 bp, Artificial Sequence
  Description of Artificial Sequence: Synthetic oligonucleotide
taggtagtgggactgtgccc

SEQ ID NO: 1343 - DNA, 18 bp, Artificial Sequence
  Description of Artificial Sequence: Synthetic oligonucleotide
gtcttggcttatcgtccc

SEQ ID NO: 1344 - DNA, 20 bp, Artificial Sequence
  Description of Artificial Sequence: Synthetic oligonucleotide
caatgatgtcctctctcccc

SEQ ID NO: 1345 - DNA, 20 bp, Artificial Sequence
  Description of Artificial Sequence: Synthetic oligonucleotide
ccgcggaattgtcccctgtg

SEQ ID NO: 1346 - DNA, 20 bp, Artificial Sequence
  Description of Artificial Sequence: Synthetic oligonucleotide
tcactcacaatccttcaccg

SEQ ID NO: 1347 - DNA, 20 bp, Artificial Sequence
  Description of Artificial Sequence: Synthetic oligonucleotide
atcctctggtcatgttgcgc

SEQ ID NO: 1348 - DNA, 20 bp, Artificial Sequence
  Description of Artificial Sequence: Synthetic oligonucleotide
tttgaatggcgatgggtccg

SEQ ID NO: 1349 - DNA, 20 bp, Artificial Sequence
  Description of Artificial Sequence: Synthetic oligonucleotide
gctgcagaacatgtggaccc

SEQ ID NO: 1350 - DNA, 20 bp, Artificial Sequence
  Description of Artificial Sequence: Synthetic oligonucleotide
taatgtctagtcccggaccc

SEQ ID NO: 1351 - DNA, 21 bp, Artificial Sequence
  Description of Artificial Sequence: Synthetic oligonucleotide
gattggtgaagggaggtactg

SEQ ID NO: 1352 - DNA, 21 bp, Artificial Sequence
  Description of Artificial Sequence: Synthetic oligonucleotide
attttttggagaagggaggtg

SEQ ID NO: 1353 - DNA, 20 bp, Artificial Sequence
  Description of Artificial Sequence: Synthetic oligonucleotide
acggtgtcgtgagctctgtg

SEQ ID NO: 1354 - DNA, 20 bp, Artificial Sequence
  Description of Artificial Sequence: Synthetic oligonucleotide
tttggagaagggtgggaccg

SEQ ID NO: 1355 - DNA, 20 bp, Artificial Sequence
  Description of Artificial Sequence: Synthetic oligonucleotide
tgtggtctggttagctcggc

SEQ ID NO: 1356 - DNA, 19 bp, Artificial Sequence
  Description of Artificial Sequence: Synthetic oligonucleotide
ttgaagggcgatgggtccg

SEQ ID NO: 1357 - DNA, 20 bp, Artificial Sequence
  Description of Artificial Sequence: Synthetic oligonucleotide
acaaaaacctcccacgtgcc

SEQ ID NO: 1358 - DNA, 20 bp, Artificial Sequence
  Description of Artificial Sequence: Synthetic oligonucleotide
agtctggtcaagccgttgtg

SEQ ID NO: 1359 - DNA, 20 bp, Artificial Sequence
  Description of Artificial Sequence: Synthetic oligonucleotide
aaccgcgtgactgtatgccc

SEQ ID NO: 1360 - DNA, 20 bp, Artificial Sequence
  Description of Artificial Sequence: Synthetic oligonucleotide
tttggggttttctcgtgccc

SEQ ID NO: 1361 - DNA, 20 bp, Artificial Sequence
  Description of Artificial Sequence: Synthetic oligonucleotide
tcctggattgtcgttgtccc

SEQ ID NO: 1362 - DNA, 19 bp, Artificial Sequence
  Description of Artificial Sequence: Synthetic oligonucleotide
gccttcgtttgttcgtccc

SEQ ID NO: 1363 - DNA, 21 bp, Artificial Sequence
  Description of Artificial Sequence: Synthetic oligonucleotide
aattggtgaagggaggtactg

SEQ ID NO: 1364 - DNA, 18 bp, Artificial Sequence
  Description of Artificial Sequence: Synthetic oligonucleotide
tggtgaagggaggtactg

SEQ ID NO: 1365 - DNA, 20 bp, Artificial Sequence
  Description of Artificial Sequence: Synthetic oligonucleotide
tttgacgggggatgggtccg

SEQ ID NO: 1366 - DNA, 21 bp, Artificial Sequence
  Description of Artificial Sequence: Synthetic oligonucleotide
gcctttcgttctgaccctccc

SEQ ID NO: 1367 - DNA, 20 bp, Artificial Sequence
  Description of Artificial Sequence: Synthetic oligonucleotide
accgtcaaacgtctgtgcgc

SEQ ID NO: 1368 - DNA, 20 bp, Artificial Sequence
  Description of Artificial Sequence: Synthetic oligonucleotide
ttccgcgtccgtttcctgtg

SEQ ID NO: 1369 - DNA, 18 bp, Artificial Sequence
  Description of Artificial Sequence: Synthetic oligonucleotide
attggtgaaggggtactg

SEQ ID NO: 1370 - DNA, 20 bp, Artificial Sequence
  Description of Artificial Sequence: Synthetic oligonucleotide
cgatatcgtcgtgttggtgc

SEQ ID NO: 1371 - DNA, 20 bp, Artificial Sequence
  Description of Artificial Sequence: Synthetic oligonucleotide
tcagttgtcttggtgcgcac

SEQ ID NO: 1372 - DNA, 20 bp, Artificial Sequence
  Description of Artificial Sequence: Synthetic oligonucleotide
agcgatgtttgttgtgtggc

SEQ ID NO: 1373 - DNA, 19 bp, Artificial Sequence
  Description of Artificial Sequence: Synthetic oligonucleotide
tcctggcttgtcgtttccc

SEQ ID NO: 1374 - DNA, 20 bp, Artificial Sequence
  Description of Artificial Sequence: Synthetic oligonucleotide
tctgtagataacgtctgccc

SEQ ID NO: 1375 - DNA, 20 bp, Artificial Sequence
  Description of Artificial Sequence: Synthetic oligonucleotide
aatcgggttatcgtcttggc

SEQ ID NO: 1376 - DNA, 19 bp, Artificial Sequence
  Description of Artificial Sequence: Synthetic oligonucleotide
ttgggtgtagggtggtatg

SEQ ID NO: 1377 - DNA, 20 bp, Artificial Sequence
  Description of Artificial Sequence: Synthetic oligonucleotide
tttgaacggcgatgggtccg

SEQ ID NO: 1378 - DNA, 20 bp, Artificial Sequence
  Description of Artificial Sequence: Synthetic oligonucleotide
gttgagtctgcgttgctgcc

SEQ ID NO: 1379 - DNA, 20 bp, Artificial Sequence
  Description of Artificial Sequence: Synthetic oligonucleotide
cattttcttcctgtcgtgtg

SEQ ID NO: 1380 - DNA, 20 bp, Artificial Sequence
  Description of Artificial Sequence: Synthetic oligonucleotide
agtaggtgtcgtcttgtggc

SEQ ID NO: 1381 - DNA, 20 bp, Artificial Sequence
  Description of Artificial Sequence: Synthetic oligonucleotide
tccctgtcgtcttgcgtccc

SEQ ID NO: 1382 - DNA, 20 bp, Artificial Sequence
  Description of Artificial Sequence: Synthetic oligonucleotide
ttgggtgtagggcggtgccg

SEQ ID NO: 1383 - DNA, 21 bp, Artificial Sequence
  Description of Artificial Sequence: Synthetic oligonucleotide
gtcccgtcgtctgttcgtccc

SEQ ID NO: 1384 - DNA, 20 bp, Artificial Sequence
  Description of Artificial Sequence: Synthetic oligonucleotide
ccaatttcttccccgtgctg

SEQ ID NO: 1385 - DNA, 20 bp, Artificial Sequence
  Description of Artificial Sequence: Synthetic oligonucleotide
ttcgaagggagatgggtccg

SEQ ID NO: 1386 - DNA, 20 bp, Artificial Sequence
  Description of Artificial Sequence: Synthetic oligonucleotide
tttgaagggggatggctccg

SEQ ID NO: 1387 - DNA, 20 bp, Artificial Sequence
  Description of Artificial Sequence: Synthetic oligonucleotide
ttttggaggtgtagggaccg

SEQ ID NO: 1388 - DNA, 20 bp, Artificial Sequence
  Description of Artificial Sequence: Synthetic oligonucleotide
tttgaagtagggtgggaccg

SEQ ID NO: 1389 - DNA, 20 bp, Artificial Sequence
  Description of Artificial Sequence: Synthetic oligonucleotide
ttgggagtagggtggcaccg

SEQ ID NO: 1390 - DNA, 19 bp, Artificial Sequence
  Description of Artificial Sequence: Synthetic oligonucleotide
attggtaagggaggtaccg

SEQ ID NO: 1391 - DNA, 20 bp, Artificial Sequence
  Description of Artificial Sequence: Synthetic oligonucleotide
ttgggggtagggtgttaccg

SEQ ID NO: 1392 - DNA, 20 bp, Artificial Sequence
  Description of Artificial Sequence: Synthetic oligonucleotide
attggaggggggtgggactg

SEQ ID NO: 1393 - DNA, 20 bp, Artificial Sequence
  Description of Artificial Sequence: Synthetic oligonucleotide
tttgaagggagatgggtcag

SEQ ID NO: 1394 - DNA, 20 bp, Artificial Sequence
  Description of Artificial Sequence: Synthetic oligonucleotide
tttgaagggcgatggctccg

SEQ ID NO: 1395 - DNA, 20 bp, Artificial Sequence
  Description of Artificial Sequence: Synthetic oligonucleotide
tttgtagggggatgggtccg

SEQ ID NO: 1396 - DNA, 20 bp, Artificial Sequence
  Description of Artificial Sequence: Synthetic oligonucleotide
tttgatgggtggtgggtccg

SEQ ID NO: 1397 - DNA, 20 bp, Artificial Sequence
  Description of Artificial Sequence: Synthetic oligonucleotide
tttgaaggagggtgggtccg

SEQ ID NO: 1398 - DNA, 20 bp, Artificial Sequence
  Description of Artificial Sequence: Synthetic oligonucleotide
tttggagaggggtgggaccg

SEQ ID NO: 1399 - DNA, 20 bp, Artificial Sequence
  Description of Artificial Sequence: Synthetic oligonucleotide
tttggagtaggatgggaccg

SEQ ID NO: 1400 - DNA, 20 bp, Artificial Sequence
  Description of Artificial Sequence: Synthetic oligonucleotide
tttgtagggtggtgggtccg

SEQ ID NO: 1401 - DNA, 20 bp, Artificial Sequence
  Description of Artificial Sequence: Synthetic oligonucleotide
atagggagaagggcgaaccg

SEQ ID NO: 1402 - DNA, 20 bp, Artificial Sequence
  Description of Artificial Sequence: Synthetic oligonucleotide
tttgaagggagatgtgtccg

SEQ ID NO: 1403 - DNA, 20 bp, Artificial Sequence
  Description of Artificial Sequence: Synthetic oligonucleotide
ccaacgttctctcacgtgtg

SEQ ID NO: 1404 - DNA, 20 bp, Artificial Sequence
  Description of Artificial Sequence: Synthetic oligonucleotide
gatgtctagggatttgtccc

SEQ ID NO: 1405 - DNA, 20 bp, Artificial Sequence
  Description of Artificial Sequence: Synthetic oligonucleotide
tttggagttttcccgtgccc

SEQ ID NO: 1406 - DNA, 19 bp, Artificial Sequence
  Description of Artificial Sequence: Synthetic oligonucleotide
tcttcttctcccatgtcgc

SEQ ID NO: 1407 - DNA, 20 bp, Artificial Sequence
  Description of Artificial Sequence: Synthetic oligonucleotide
tcacctatgctagggtgcca

SEQ ID NO: 1408 - DNA, 20 bp, Artificial Sequence
  Description of Artificial Sequence: Synthetic oligonucleotide
gcgtttcgttctgacctccc

SEQ ID NO: 1409 - DNA, 20 bp, Artificial Sequence
  Description of Artificial Sequence: Synthetic oligonucleotide
ttcctctgtattgcgcaccc

SEQ ID NO: 1410 - DNA, 20 bp, Artificial Sequence
  Description of Artificial Sequence: Synthetic oligonucleotide
ttgggtgtggggtggtactg

SEQ ID NO: 1411 - DNA, 20 bp, Artificial Sequence
  Description of Artificial Sequence: Synthetic oligonucleotide
gtaacgcgtctgcacgtgtc

SEQ ID NO: 1412 - DNA, 20 bp, Artificial Sequence
  Description of Artificial Sequence: Synthetic oligonucleotide
agagtcgtgctgattccccc

SEQ ID NO: 1413 - DNA, 20 bp, Artificial Sequence
  Description of Artificial Sequence: Synthetic oligonucleotide
agcgagtatgtttagtgctg

SEQ ID NO: 1414 - DNA, 20 bp, Artificial Sequence
  Description of Artificial Sequence: Synthetic oligonucleotide
atcggtccactttgcgtgcc

SEQ ID NO: 1415 - DNA, 20 bp, Artificial Sequence
  Description of Artificial Sequence: Synthetic oligonucleotide
gcttgtcgttctcctgtctg

SEQ ID NO: 1416 - DNA, 18 bp, Artificial Sequence
  Description of Artificial Sequence: Synthetic oligonucleotide
tttggggtgatgggtccg

SEQ ID NO: 1417 - DNA, 20 bp, Artificial Sequence
  Description of Artificial Sequence: Synthetic oligonucleotide
aatgtcctttgcggtctcgc

SEQ ID NO: 1418 - DNA, 20 bp, Artificial Sequence
  Description of Artificial Sequence: Synthetic oligonucleotide
ccgcacggttattccctccg

SEQ ID NO: 1419 - DNA, 22 bp, Artificial Sequence
  Description of Artificial Sequence: Synthetic oligonucleotide
caagtggtcttacggtccaccc

SEQ ID NO: 1420 - DNA, 20 bp, Artificial Sequence
  Description of Artificial Sequence: Synthetic oligonucleotide
atagtcgagcctctgtgcgc

SEQ ID NO: 1421 - DNA, 20 bp, Artificial Sequence
  Description of Artificial Sequence: Synthetic oligonucleotide
tccttcggtctgctcatgcc

SEQ ID NO: 1422 - DNA, 20 bp, Artificial Sequence
  Description of Artificial Sequence: Synthetic oligonucleotide
cgtatcgacttgcccctgtg

SEQ ID NO: 1423 - DNA, 20 bp, Artificial Sequence
  Description of Artificial Sequence: Synthetic oligonucleotide
cctgtcgtttgtactgttgc

SEQ ID NO: 1424 - DNA, 20 bp, Artificial Sequence
  Description of Artificial Sequence: Synthetic oligonucleotide
ttagtcgattgccatgtgtg

SEQ ID NO: 1425 - DNA, 20 bp, Artificial Sequence
  Description of Artificial Sequence: Synthetic oligonucleotide
tagagtcgtaaccgtgtccc

SEQ ID NO: 1426 - DNA, 20 bp, Artificial Sequence
  Description of Artificial Sequence: Synthetic oligonucleotide
tccaacacctgatgtcgctg

SEQ ID NO: 1427 - DNA, 20 bp, Artificial Sequence
  Description of Artificial Sequence: Synthetic oligonucleotide
aggctagctgtctggttgtg

SEQ ID NO: 1428 - DNA, 20 bp, Artificial Sequence
  Description of Artificial Sequence: Synthetic oligonucleotide
tgagaatggatctggtgggc

SEQ ID NO: 1429 - DNA, 20 bp, Artificial Sequence
  Description of Artificial Sequence: Synthetic oligonucleotide
gcggataaatggcctgggta

SEQ ID NO: 1430 - DNA, 19 bp, Artificial Sequence
  Description of Artificial Sequence: Synthetic oligonucleotide
attggtgaaggaggtaccg

SEQ ID NO: 1431 - DNA, 20 bp, Artificial Sequence
  Description of Artificial Sequence: Synthetic oligonucleotide
gtgactttatgagttgtgtg

SEQ ID NO: 1432 - DNA, 20 bp, Artificial Sequence
  Description of Artificial Sequence: Synthetic oligonucleotide
gatgacggcgttgtcgctac

SEQ ID NO: 1433 - DNA, 20 bp, Artificial Sequence
  Description of Artificial Sequence: Synthetic oligonucleotide
gtgatcagtcctctggtctg

SEQ ID NO: 1434 - DNA, 20 bp, Artificial Sequence
  Description of Artificial Sequence: Synthetic oligonucleotide
ttagtcgaaggtgtgcgtgc

SEQ ID NO: 1435 - DNA, 20 bp, Artificial Sequence
  Description of Artificial Sequence: Synthetic oligonucleotide
tatgtagtcgtcgtgtgcgc

SEQ ID NO: 1436 - DNA, 20 bp, Artificial Sequence
  Description of Artificial Sequence: Synthetic oligonucleotide
cagaggaggtggtgacaccg

SEQ ID NO: 1437 - DNA, 20 bp, Artificial Sequence
  Description of Artificial Sequence: Synthetic oligonucleotide
cttgtcgtctcctttcaccc

SEQ ID NO: 1438 - DNA, 20 bp, Artificial Sequence
  Description of Artificial Sequence: Synthetic oligonucleotide
gcctgtcgttctgacctccc

SEQ ID NO: 1439 - DNA, 20 bp, Artificial Sequence
  Description of Artificial Sequence: Synthetic oligonucleotide
atcctgccttgtcgttggcc

SEQ ID NO: 1440 - DNA, 20 bp, Artificial Sequence
  Description of Artificial Sequence: Synthetic oligonucleotide
tttgaagggtgtagggaccg

SEQ ID NO: 1441 - DNA, 20 bp, Artificial Sequence
  Description of Artificial Sequence: Synthetic oligonucleotide
ccgtagcgtctccatctgtg

SEQ ID NO: 1442 - DNA, 20 bp, Artificial Sequence
  Description of Artificial Sequence: Synthetic oligonucleotide
ctagtccgtttgtaacgcca

SEQ ID NO: 1443 - DNA, 20 bp, Artificial Sequence
  Description of Artificial Sequence: Synthetic oligonucleotide
tgagcgctctgtttccgccc

SEQ ID NO: 1444 - DNA, 19 bp, Artificial Sequence
  Description of Artificial Sequence: Synthetic oligonucleotide
tgggactctgcgtgttgtg

SEQ ID NO: 1445 - DNA, 20 bp, Artificial Sequence
  Description of Artificial Sequence: Synthetic oligonucleotide
ctaataggtggagtagggta

SEQ ID NO: 1446 - DNA, 20 bp, Artificial Sequence
  Description of Artificial Sequence: Synthetic oligonucleotide
tttgaagggtgatgggtcgc

SEQ ID NO: 1447 - DNA, 20 bp, Artificial Sequence
  Description of Artificial Sequence: Synthetic oligonucleotide
tactacaagatacagtgccc

SEQ ID NO: 1448 - DNA, 20 bp, Artificial Sequence
  Description of Artificial Sequence: Synthetic oligonucleotide
tccagcccgttgtcgttggc

SEQ ID NO: 1449 - DNA, 20 bp, Artificial Sequence
  Description of Artificial Sequence: Synthetic oligonucleotide
cgatcgtaggtcgttgtgcc

SEQ ID NO: 1450 - DNA, 20 bp, Artificial Sequence
  Description of Artificial Sequence: Synthetic oligonucleotide
acgaagcgtttgtacgggcc

SEQ ID NO: 1451 - DNA, 21 bp, Artificial Sequence
  Description of Artificial Sequence: Synthetic oligonucleotide
gtcctgtcgtgtgttcgtccc

SEQ ID NO: 1452 - DNA, 20 bp, Artificial Sequence
  Description of Artificial Sequence: Synthetic oligonucleotide
attggtggagggagggaccg

SEQ ID NO: 1453 - DNA, 18 bp, Artificial Sequence
  Description of Artificial Sequence: Synthetic oligonucleotide
gccttgttctgacctccc

SEQ ID NO: 1454 - DNA, 20 bp, Artificial Sequence
  Description of Artificial Sequence: Synthetic oligonucleotide
gttgtcatgacgttcgtccc

SEQ ID NO: 1455 - DNA, 20 bp, Artificial Sequence
  Description of Artificial Sequence: Synthetic oligonucleotide
tcgatcttggtgtcccttgc

SEQ ID NO: 1456 - DNA, 20 bp, Artificial Sequence
  Description of Artificial Sequence: Synthetic oligonucleotide
atgatgtgtagtagccgccc

SEQ ID NO: 1457 - DNA, 20 bp, Artificial Sequence
  Description of Artificial Sequence: Synthetic oligonucleotide
catgaatgtttcccgcgcac

SEQ ID NO: 1458 - DNA, 20 bp, Artificial Sequence
  Description of Artificial Sequence: Synthetic oligonucleotide
tcgctaatctcctgtctgtg

SEQ ID NO: 1459 - DNA, 20 bp, Artificial Sequence
  Description of Artificial Sequence: Synthetic oligonucleotide
aggtcctcagattgcgtgcc

SEQ ID NO: 1460 - DNA, 20 bp, Artificial Sequence
  Description of Artificial Sequence: Synthetic oligonucleotide
attggagaggggagggactg

SEQ ID NO: 1461 - DNA, 20 bp, Artificial Sequence
  Description of Artificial Sequence: Synthetic oligonucleotide
ttgggcgtagggtggcaccg

SEQ ID NO: 1462 - DNA, 20 bp, Artificial Sequence
  Description of Artificial Sequence: Synthetic oligonucleotide
tgtcgtcaacgcgttctgtg

SEQ ID NO: 1463 - DNA, 19 bp, Artificial Sequence
  Description of Artificial Sequence: Synthetic oligonucleotide
attggtgaagggtgaaccg

SEQ ID NO: 1464 - DNA, 20 bp, Artificial Sequence
  Description of Artificial Sequence: Synthetic oligonucleotide
tttgaagggcgatgggtcca

SEQ ID NO: 1465 - DNA, 20 bp, Artificial Sequence
  Description of Artificial Sequence: Synthetic oligonucleotide
attgcgctactctcctgtgc

SEQ ID NO: 1466 - DNA, 20 bp, Artificial Sequence
  Description of Artificial Sequence: Synthetic oligonucleotide
ccgtactttacagtcgtgcc

SEQ ID NO: 1467 - DNA, 20 bp, Artificial Sequence
  Description of Artificial Sequence: Synthetic oligonucleotide
tattggaggtgtaggaaccg

SEQ ID NO: 1468 - DNA, 20 bp, Artificial Sequence
  Description of Artificial Sequence: Synthetic oligonucleotide
tcgtcacaaactgtgtgccc

SEQ ID NO: 1469 - DNA, 20 bp, Artificial Sequence
  Description of Artificial Sequence: Synthetic oligonucleotide
gaattcacgtgtcgctgggc

SEQ ID NO: 1470 - DNA, 20 bp, Artificial Sequence
  Description of Artificial Sequence: Synthetic oligonucleotide
tcgattgtgtcgttctgcgg

SEQ ID NO: 1471 - DNA, 20 bp, Artificial Sequence
  Description of Artificial Sequence: Synthetic oligonucleotide
aagattctgggacactactg

SEQ ID NO: 1472 - DNA, 20 bp, Artificial Sequence
  Description of Artificial Sequence: Synthetic oligonucleotide
catcctatcttgttccgcac

SEQ ID NO: 1473 - DNA, 20 bp, Artificial Sequence
  Description of Artificial Sequence: Synthetic oligonucleotide
tcacttggtttcgactgcgc

SEQ ID NO: 1474 - DNA, 20 bp, Artificial Sequence
  Description of Artificial Sequence: Synthetic oligonucleotide
atgagtgagttgtgtgcccc

SEQ ID NO: 1475 - DNA, 20 bp, Artificial Sequence
  Description of Artificial Sequence: Synthetic oligonucleotide
gctccaatgttgtctgcggc

SEQ ID NO: 1476 - DNA, 20 bp, Artificial Sequence
  Description of Artificial Sequence: Synthetic oligonucleotide
tgagcccatggctttttggc

SEQ ID NO: 1477 - DNA, 20 bp, Artificial Sequence
  Description of Artificial Sequence: Synthetic oligonucleotide
gtgtcaggatatatgctctg

SEQ ID NO: 1478 - DNA, 20 bp, Artificial Sequence
  Description of Artificial Sequence: Synthetic oligonucleotide
tttgaagggggatggatccg

SEQ ID NO: 1479 - DNA, 19 bp, Artificial Sequence
  Description of Artificial Sequence: Synthetic oligonucleotide
tcctgtcgtctgttcgttc

SEQ ID NO: 1480 - DNA, 20 bp, Artificial Sequence
  Description of Artificial Sequence: Synthetic oligonucleotide
ttgatcctcctctcgtggac

SEQ ID NO: 1481 - DNA, 20 bp, Artificial Sequence
  Description of Artificial Sequence: Synthetic oligonucleotide
tttgaaggaagatgggtccg

SEQ ID NO: 1482 - DNA, 20 bp, Artificial Sequence
  Description of Artificial Sequence: Synthetic oligonucleotide
tttgaagggtggttggtccg

SEQ ID NO: 1483 - DNA, 20 bp, Artificial Sequence
  Description of Artificial Sequence: Synthetic oligonucleotide
ttttaagggcgatgggtccg

SEQ ID NO: 1484 - DNA, 20 bp, Artificial Sequence
  Description of Artificial Sequence: Synthetic oligonucleotide
aatcgtagcctccatgtgcc

SEQ ID NO: 1485 - DNA, 20 bp, Artificial Sequence
  Description of Artificial Sequence: Synthetic oligonucleotide
tttgaagggagatgggtctg

SEQ ID NO: 1486 - DNA, 20 bp, Artificial Sequence
  Description of Artificial Sequence: Synthetic oligonucleotide
atccgtaagtcacccgtgtg

SEQ ID NO: 1487 - DNA, 20 bp, Artificial Sequence
  Description of Artificial Sequence: Synthetic oligonucleotide
gttttggttgtgtgccgctg

SEQ ID NO: 1488 - DNA, 20 bp, Artificial Sequence
  Description of Artificial Sequence: Synthetic oligonucleotide
tttgaaggggggtgggactg

SEQ ID NO: 1489 - DNA, 20 bp, Artificial Sequence
  Description of Artificial Sequence: Synthetic oligonucleotide
tttgaaggacgatgggtccg

SEQ ID NO: 1490 - DNA, 20 bp, Artificial Sequence
  Description of Artificial Sequence: Synthetic oligonucleotide
tgtagggaggtggttatcgt

SEQ ID NO: 1491 - DNA, 18 bp, Artificial Sequence
  Description of Artificial Sequence: Synthetic oligonucleotide
ttgggtgtaggggtaccg

SEQ ID NO: 1492 - DNA, 18 bp, Artificial Sequence
  Description of Artificial Sequence: Synthetic oligonucleotide
ttaagggtgatgggtccg

SEQ ID NO: 1493 - DNA, 20 bp, Artificial Sequence
  Description of Artificial Sequence: Synthetic oligonucleotide
tttggaggggggtggtaccg

SEQ ID NO: 1494 - DNA, 20 bp, Artificial Sequence
  Description of Artificial Sequence: Synthetic oligonucleotide
tattggaggtgtagagaccg

SEQ ID NO: 1495 - DNA, 20 bp, Artificial Sequence
  Description of Artificial Sequence: Synthetic oligonucleotide
tgagtgtctcccttggtctg

SEQ ID NO: 1496 - DNA, 20 bp, Artificial Sequence
  Description of Artificial Sequence: Synthetic oligonucleotide
gttgagtagatctggtgccg

SEQ ID NO: 1497 - DNA, 20 bp, Artificial Sequence
  Description of Artificial Sequence: Synthetic oligonucleotide
gtatgaagtcgccgcgtctg

SEQ ID NO: 1498 - DNA, 20 bp, Artificial Sequence
  Description of Artificial Sequence: Synthetic oligonucleotide
gccataatcttctgctgccg

SEQ ID NO: 1499 - DNA, 20 bp, Artificial Sequence
  Description of Artificial Sequence: Synthetic oligonucleotide
gtcttctggcctatcgtccc

SEQ ID NO: 1500 - DNA, 20 bp, Artificial Sequence
  Description of Artificial Sequence: Synthetic oligonucleotide
actatgtcgtcttgtcccca

SEQ ID NO: 1501 - DNA, 20 bp, Artificial Sequence
  Description of Artificial Sequence: Synthetic oligonucleotide
tagactccgttccctgtcgc

SEQ ID NO: 1502 - DNA, 20 bp, Artificial Sequence
  Description of Artificial Sequence: Synthetic oligonucleotide
cgattcgatctgttcgtccc

SEQ ID NO: 1503 - DNA, 20 bp, Artificial Sequence
  Description of Artificial Sequence: Synthetic oligonucleotide
agtgaagtttggagttgcgc

SEQ ID NO: 1504 - DNA, 20 bp, Artificial Sequence
  Description of Artificial Sequence: Synthetic oligonucleotide
gaagtctgtttttgccgcgc

SEQ ID NO: 1505 - DNA, 20 bp, Artificial Sequence
  Description of Artificial Sequence: Synthetic oligonucleotide
catctagactcccgcgtgtg

SEQ ID NO: 1506 - DNA, 20 bp, Artificial Sequence
  Description of Artificial Sequence: Synthetic oligonucleotide
ttgtctgcgatggcggtggc

SEQ ID NO: 1507 - DNA, 20 bp, Artificial Sequence
  Description of Artificial Sequence: Synthetic oligonucleotide
ggctttcgttctgacctccc

SEQ ID NO: 1508 - DNA, 20 bp, Artificial Sequence
  Description of Artificial Sequence: Synthetic oligonucleotide
tatttggtgaagtggaggtg

SEQ ID NO: 1509 - DNA, 20 bp, Artificial Sequence
  Description of Artificial Sequence: Synthetic oligonucleotide
cccataaccaatgtgtgccc

SEQ ID NO: 1510 - DNA, 20 bp, Artificial Sequence
  Description of Artificial Sequence: Synthetic oligonucleotide
tgtggtgtaactggtgaccc

SEQ ID NO: 1511 - DNA, 20 bp, Artificial Sequence
  Description of Artificial Sequence: Synthetic oligonucleotide
attgacgtcgctgcgcactg

SEQ ID NO: 1512 - DNA, 20 bp, Artificial Sequence
  Description of Artificial Sequence: Synthetic oligonucleotide
caccctaagacctcaatccg

SEQ ID NO: 1513 - DNA, 20 bp, Artificial Sequence
  Description of Artificial Sequence: Synthetic oligonucleotide
ctagttctctcgtcggtctg

SEQ ID NO: 1514 - DNA, 20 bp, Artificial Sequence
  Description of Artificial Sequence: Synthetic oligonucleotide
attggggaagggagggactg

SEQ ID NO: 1515 - DNA, 20 bp, Artificial Sequence
  Description of Artificial Sequence: Synthetic oligonucleotide
gttcctcgtctctgcatgtc

SEQ ID NO: 1516 - DNA, 20 bp, Artificial Sequence
  Description of Artificial Sequence: Synthetic oligonucleotide
tttgaggggtgatgggtccc

SEQ ID NO: 1517 - DNA, 20 bp, Artificial Sequence
  Description of Artificial Sequence: Synthetic oligonucleotide
agttctggacatgccgcgac

SEQ ID NO: 1518 - DNA, 20 bp, Artificial Sequence
  Description of Artificial Sequence: Synthetic oligonucleotide
tactggttcccacttgtctg

SEQ ID NO: 1519 - DNA, 20 bp, Artificial Sequence
  Description of Artificial Sequence: Synthetic oligonucleotide
tgtgtcttgtctgcttgctg

SEQ ID NO: 1520 - DNA, 20 bp, Artificial Sequence
  Description of Artificial Sequence: Synthetic oligonucleotide
ccgttgtctaggtgtatgcc

SEQ ID NO: 1521 - DNA, 20 bp, Artificial Sequence
  Description of Artificial Sequence: Synthetic oligonucleotide
aaatcgaccttccacgtggc

SEQ ID NO: 1522 - DNA, 20 bp, Artificial Sequence
  Description of Artificial Sequence: Synthetic oligonucleotide
taaagtcgtcaacacagcgc

SEQ ID NO: 1523 - DNA, 20 bp, Artificial Sequence
  Description of Artificial Sequence: Synthetic oligonucleotide
ttcatccttcgacgtctgtg

SEQ ID NO: 1524 - DNA, 20 bp, Artificial Sequence
  Description of Artificial Sequence: Synthetic oligonucleotide
attaggagtgtagtcgtgcc

SEQ ID NO: 1525 - DNA, 19 bp, Artificial Sequence
  Description of Artificial Sequence: Synthetic oligonucleotide
ctgtcgtcttgttcgtccc

SEQ ID NO: 1526 - DNA, 20 bp, Artificial Sequence
  Description of Artificial Sequence: Synthetic oligonucleotide
tttgaagggggatgggtcag

SEQ ID NO: 1527 - DNA, 20 bp, Artificial Sequence
  Description of Artificial Sequence: Synthetic oligonucleotide
aaccaagcctctctgcgtgc

SEQ ID NO: 1528 - DNA, 20 bp, Artificial Sequence
  Description of Artificial Sequence: Synthetic oligonucleotide
cttgtcgtcttgtttgtccc

SEQ ID NO: 1529 - DNA, 20 bp, Artificial Sequence
  Description of Artificial Sequence: Synthetic oligonucleotide
ttgggtgaagggtggtactg

SEQ ID NO: 1530 - DNA, 20 bp, Artificial Sequence
  Description of Artificial Sequence: Synthetic oligonucleotide
gagtcatgtacacgattgtg

SEQ ID NO: 1531 - DNA, 20 bp, Artificial Sequence
  Description of Artificial Sequence: Synthetic oligonucleotide
tacgataggctcatgcgctg

SEQ ID NO: 1532 - DNA, 20 bp, Artificial Sequence
  Description of Artificial Sequence: Synthetic oligonucleotide
actgagaataatggtggccg

SEQ ID NO: 1533 - DNA, 20 bp, Artificial Sequence
  Description of Artificial Sequence: Synthetic oligonucleotide
acctccacactatcgtgccc

SEQ ID NO: 1534 - DNA, 19 bp, Artificial Sequence
  Description of Artificial Sequence: Synthetic oligonucleotide
ctattggtgaaggggggtg

SEQ ID NO: 1535 - DNA, 20 bp, Artificial Sequence
  Description of Artificial Sequence: Synthetic oligonucleotide
tcctcttctgtagtctgtgc

SEQ ID NO: 1536 - DNA, 18 bp, Artificial Sequence
  Description of Artificial Sequence: Synthetic oligonucleotide
tttttggtgatgggtccg

SEQ ID NO: 1537 - DNA, 20 bp, Artificial Sequence
  Description of Artificial Sequence: Synthetic oligonucleotide
tgagacgttcggtacatcgc

SEQ ID NO: 1538 - DNA, 20 bp, Artificial Sequence
  Description of Artificial Sequence: Synthetic oligonucleotide
cattggaatcccactctccc

SEQ ID NO: 1539 - DNA, 20 bp, Artificial Sequence
  Description of Artificial Sequence: Synthetic oligonucleotide
aattcgtcaatgcgctgccc

SEQ ID NO: 1540 - DNA, 20 bp, Artificial Sequence
  Description of Artificial Sequence: Synthetic oligonucleotide
agtgagcctcttcgatgccg

SEQ ID NO: 1541 - DNA, 20 bp, Artificial Sequence
  Description of Artificial Sequence: Synthetic oligonucleotide
ttagggcattccttcctgcc

SEQ ID NO: 1542 - DNA, 20 bp, Artificial Sequence
  Description of Artificial Sequence: Synthetic oligonucleotide
gcaggagagtttagcggcgc

SEQ ID NO: 1543 - DNA, 20 bp, Artificial Sequence
  Description of Artificial Sequence: Synthetic oligonucleotide
tatcctagtcccctcgtctg

SEQ ID NO: 1544 - DNA, 20 bp, Artificial Sequence
  Description of Artificial Sequence: Synthetic oligonucleotide
acatggccttgcacgttgtc

SEQ ID NO: 1545 - DNA, 19 bp, Artificial Sequence
  Description of Artificial Sequence: Synthetic oligonucleotide
ggagaaaccctgtggtgta

SEQ ID NO: 1546 - DNA, 20 bp, Artificial Sequence
  Description of Artificial Sequence: Synthetic oligonucleotide
cttgtctccggtctgctggc

SEQ ID NO: 1547 - DNA, 20 bp, Artificial Sequence
  Description of Artificial Sequence: Synthetic oligonucleotide
tagtgtctggtattgcacac

SEQ ID NO: 1548 - DNA, 20 bp, Artificial Sequence
  Description of Artificial Sequence: Synthetic oligonucleotide
acagtcggattgggccacca

SEQ ID NO: 1549 - DNA, 21 bp, Artificial Sequence
  Description of Artificial Sequence: Synthetic oligonucleotide
attggtgaagggaggttactg

SEQ ID NO: 1550 - DNA, 20 bp, Artificial Sequence
  Description of Artificial Sequence: Synthetic oligonucleotide
ttgggtgtagggagggaccg

SEQ ID NO: 1551 - DNA, 20 bp, Artificial Sequence
  Description of Artificial Sequence: Synthetic oligonucleotide
gtgtctgagtgtgccttccc

SEQ ID NO: 1552 - DNA, 19 bp, Artificial Sequence
  Description of Artificial Sequence: Synthetic oligonucleotide
tttgaaggtggtgggtccg

SEQ ID NO: 1553 - DNA, 20 bp, Artificial Sequence
  Description of Artificial Sequence: Synthetic oligonucleotide
atcgttctctctcccgtgcc

SEQ ID NO: 1554 - DNA, 20 bp, Artificial Sequence
  Description of Artificial Sequence: Synthetic oligonucleotide
aggaatacagtcaaggtctg

SEQ ID NO: 1555 - DNA, 20 bp, Artificial Sequence
  Description of Artificial Sequence: Synthetic oligonucleotide
tccaaacgagctctgctgcc

SEQ ID NO: 1556 - DNA, 20 bp, Artificial Sequence
  Description of Artificial Sequence: Synthetic oligonucleotide
atgaaggcccgtacaccctg

SEQ ID NO: 1557 - DNA, 20 bp, Artificial Sequence
  Description of Artificial Sequence: Synthetic oligonucleotide
tgtcctttctccgtctgccg

SEQ ID NO: 1558 - DNA, 20 bp, Artificial Sequence
  Description of Artificial Sequence: Synthetic oligonucleotide
gtccaccatgatgttgtctg

SEQ ID NO: 1559 - DNA, 20 bp, Artificial Sequence
  Description of Artificial Sequence: Synthetic oligonucleotide
ttcctcgatcaccgatactg

SEQ ID NO: 1560 - DNA, 20 bp, Artificial Sequence
  Description of Artificial Sequence: Synthetic oligonucleotide
accatgttttaagtgtgcgc

SEQ ID NO: 1561 - DNA, 20 bp, Artificial Sequence
  Description of Artificial Sequence: Synthetic oligonucleotide
tagtgtgagtcgcccttgtg

SEQ ID NO: 1562 - DNA, 20 bp, Artificial Sequence
  Description of Artificial Sequence: Synthetic oligonucleotide
tccattgcttctcgtctggc

SEQ ID NO: 1563 - DNA, 20 bp, Artificial Sequence
  Description of Artificial Sequence: Synthetic oligonucleotide
tgatacaaattttactgctg

SEQ ID NO: 1564 - DNA, 20 bp, Artificial Sequence
  Description of Artificial Sequence: Synthetic oligonucleotide
tttgtacaacggtctggcgc

SEQ ID NO: 1565 - DNA, 20 bp, Artificial Sequence
  Description of Artificial Sequence: Synthetic oligonucleotide
taccacatatagactgggcc

SEQ ID NO: 1566 - DNA, 20 bp, Artificial Sequence
  Description of Artificial Sequence: Synthetic oligonucleotide
attgcccatatcctcctgcc

SEQ ID NO: 1567 - DNA, 20 bp, Artificial Sequence
  Description of Artificial Sequence: Synthetic oligonucleotide
atcgtttgtgctatggtggc

SEQ ID NO: 1568 - DNA, 20 bp, Artificial Sequence
  Description of Artificial Sequence: Synthetic oligonucleotide
gccttttcgtcttgcctccc

SEQ ID NO: 1569 - DNA, 20 bp, Artificial Sequence
  Description of Artificial Sequence: Synthetic oligonucleotide
attggcgaagggaggcactg

SEQ ID NO: 1570 - DNA, 19 bp, Artificial Sequence
  Description of Artificial Sequence: Synthetic oligonucleotide
tgtaggaggaggagtaccg

SEQ ID NO: 1571 - DNA, 20 bp, Artificial Sequence
  Description of Artificial Sequence: Synthetic oligonucleotide
ttcctctatcctcgtgtccc

SEQ ID NO: 1572 - DNA, 20 bp, Artificial Sequence
  Description of Artificial Sequence: Synthetic oligonucleotide
atagggagaggggtgaaccg

SEQ ID NO: 1573 - DNA, 20 bp, Artificial Sequence
  Description of Artificial Sequence: Synthetic oligonucleotide
cgaataggtctcgccatggc

SEQ ID NO: 1574 - DNA, 20 bp, Artificial Sequence
  Description of Artificial Sequence: Synthetic oligonucleotide
tgactcgtctgtttcgttcc

SEQ ID NO: 1575 - DNA, 20 bp, Artificial Sequence
  Description of Artificial Sequence: Synthetic oligonucleotide
tccactgttcccaacctccc

SEQ ID NO: 1576 - DNA, 20 bp, Artificial Sequence
  Description of Artificial Sequence: Synthetic oligonucleotide
tttggtggggggtgggaccg

SEQ ID NO: 1577 - DNA, 19 bp, Artificial Sequence
  Description of Artificial Sequence: Synthetic oligonucleotide
gcctttcgttctgcccacc

SEQ ID NO: 1578 - DNA, 20 bp, Artificial Sequence
  Description of Artificial Sequence: Synthetic oligonucleotide
accgacgaacaatgtggccc

SEQ ID NO: 1579 - DNA, 20 bp, Artificial Sequence
  Description of Artificial Sequence: Synthetic oligonucleotide
caccgttagcgtttgctggc

SEQ ID NO: 1580 - DNA, 20 bp, Artificial Sequence
  Description of Artificial Sequence: Synthetic oligonucleotide
ttggaagtagggtgggaccg

SEQ ID NO: 1581 - DNA, 20 bp, Artificial Sequence
  Description of Artificial Sequence: Synthetic oligonucleotide
tgtccatatcgtaacctccc

SEQ ID NO: 1582 - DNA, 20 bp, Artificial Sequence
  Description of Artificial Sequence: Synthetic oligonucleotide
tttgaaggggggtggtaccg

SEQ ID NO: 1583 - DNA, 20 bp, Artificial Sequence
  Description of Artificial Sequence: Synthetic oligonucleotide
tcggactagtcgttttgcgc

SEQ ID NO: 1584 - DNA, 20 bp, Artificial Sequence
  Description of Artificial Sequence: Synthetic oligonucleotide
tcctttcgttctgagctccc

SEQ ID NO: 1585 - DNA, 20 bp, Artificial Sequence
  Description of Artificial Sequence: Synthetic oligonucleotide
tttgacgggtgctgggtccg

SEQ ID NO: 1586 - DNA, 20 bp, Artificial Sequence
  Description of Artificial Sequence: Synthetic oligonucleotide
attggtgacgggaggtaccg

SEQ ID NO: 1587 - DNA, 20 bp, Artificial Sequence
  Description of Artificial Sequence: Synthetic oligonucleotide
tttgaagggagatgggtcca

SEQ ID NO: 1588 - DNA, 20 bp, Artificial Sequence
  Description of Artificial Sequence: Synthetic oligonucleotide
tttgaagggagataggtccg

SEQ ID NO: 1589 - DNA, 21 bp, Artificial Sequence
  Description of Artificial Sequence: Synthetic oligonucleotide
gcctttcgtttctgccctccc

SEQ ID NO: 1590 - DNA, 20 bp, Artificial Sequence
  Description of Artificial Sequence: Synthetic oligonucleotide
gttgatgtcttgggctgctg

SEQ ID NO: 1591 - DNA, 21 bp, Artificial Sequence
  Description of Artificial Sequence: Synthetic oligonucleotide
gcctttcgttctgccttcccc

SEQ ID NO: 1592 - DNA, 20 bp, Artificial Sequence
  Description of Artificial Sequence: Synthetic oligonucleotide
ttgggtgtagggcgggaccg

SEQ ID NO: 1593 - DNA, 20 bp, Artificial Sequence
  Description of Artificial Sequence: Synthetic oligonucleotide
gttgaagggtgatgggcccg

SEQ ID NO: 1594 - DNA, 20 bp, Artificial Sequence
  Description of Artificial Sequence: Synthetic oligonucleotide
tttgaagggggattggtccg

SEQ ID NO: 1595 - DNA, 19 bp, Artificial Sequence
  Description of Artificial Sequence: Synthetic oligonucleotide
attggtgaagggaggtctg

SEQ ID NO: 1596 - DNA, 20 bp, Artificial Sequence
  Description of Artificial Sequence: Synthetic oligonucleotide
tttgcagggtgatgggcccg

SEQ ID NO: 1597 - DNA, 20 bp, Artificial Sequence
  Description of Artificial Sequence: Synthetic oligonucleotide
attggagaagggtgggaccg

SEQ ID NO: 1598 - DNA, 20 bp, Artificial Sequence
  Description of Artificial Sequence: Synthetic oligonucleotide
tttgaagggagattggtccg

SEQ ID NO: 1599 - DNA, 20 bp, Artificial Sequence
  Description of Artificial Sequence: Synthetic oligonucleotide
cttgtcgtcttgttcgttcc

SEQ ID NO: 1600 - DNA, 20 bp, Artificial Sequence
  Description of Artificial Sequence: Synthetic oligonucleotide
tgggtcgtcttctgttcccc

SEQ ID NO: 1601 - DNA, 20 bp, Artificial Sequence
  Description of Artificial Sequence: Synthetic oligonucleotide
ttggcatatcacacggtgtc

SEQ ID NO: 1602 - DNA, 20 bp, Artificial Sequence
  Description of Artificial Sequence: Synthetic oligonucleotide
ttggtcgtctgaaacctccc

SEQ ID NO: 1603 - DNA, 20 bp, Artificial Sequence
  Description of Artificial Sequence: Synthetic oligonucleotide
tggatcgtttggtgacacgc

SEQ ID NO: 1604 - DNA, 20 bp, Artificial Sequence
  Description of Artificial Sequence: Synthetic oligonucleotide
agtcccaactgttgttgctg

SEQ ID NO: 1605 - DNA, 20 bp, Artificial Sequence
  Description of Artificial Sequence: Synthetic oligonucleotide
aaaagggtcttcgtctgcgc

SEQ ID NO: 1606 - DNA, 20 bp, Artificial Sequence
  Description of Artificial Sequence: Synthetic oligonucleotide
ccgagtcttcctgcgtgcgc

SEQ ID NO: 1607 - DNA, 20 bp, Artificial Sequence
  Description of Artificial Sequence: Synthetic oligonucleotide
aaaccgtagccgcacgtggg

SEQ ID NO: 1608 - DNA, 20 bp, Artificial Sequence
  Description of Artificial Sequence: Synthetic oligonucleotide
tggaatgttacctctagctg

SEQ ID NO: 1609 - DNA, 20 bp, Artificial Sequence
  Description of Artificial Sequence: Synthetic oligonucleotide
cctgtcgcactgcggtactg

SEQ ID NO: 1610 - DNA, 20 bp, Artificial Sequence
  Description of Artificial Sequence: Synthetic oligonucleotide
tgtccccgagtctgtgtggc

SEQ ID NO: 1611 - DNA, 20 bp, Artificial Sequence
  Description of Artificial Sequence: Synthetic oligonucleotide
tgcgatgcgtccgatctcgc

SEQ ID NO: 1612 - DNA, 20 bp, Artificial Sequence
  Description of Artificial Sequence: Synthetic oligonucleotide
gttcttggcgtcttatactg

SEQ ID NO: 1613 - DNA, 20 bp, Artificial Sequence
  Description of Artificial Sequence: Synthetic oligonucleotide
cccgctgtattcctcgtccc

SEQ ID NO: 1614 - DNA, 19 bp, Artificial Sequence
  Description of Artificial Sequence: Synthetic oligonucleotide
cttgtcgtcttgttcgtcc

SEQ ID NO: 1615 - DNA, 20 bp, Artificial Sequence
  Description of Artificial Sequence: Synthetic oligonucleotide
gaatccgtgtgatatggctg

SEQ ID NO: 1616 - DNA, 20 bp, Artificial Sequence
  Description of Artificial Sequence: Synthetic oligonucleotide
tccgtaaatgttgttgtcgc

SEQ ID NO: 1617 - DNA, 20 bp, Artificial Sequence
  Description of Artificial Sequence: Synthetic oligonucleotide
atagtctacacatgactgcc

SEQ ID NO: 1618 - DNA, 20 bp, Artificial Sequence
  Description of Artificial Sequence: Synthetic oligonucleotide
acctacgtcttttccgtgtg

SEQ ID NO: 1619 - DNA, 20 bp, Artificial Sequence
  Description of Artificial Sequence: Synthetic oligonucleotide
tcccatgccttcctgtaccg

SEQ ID NO: 1620 - DNA, 19 bp, Artificial Sequence
  Description of Artificial Sequence: Synthetic oligonucleotide
tcaccaaactcgtgcgccc

SEQ ID NO: 1621 - DNA, 20 bp, Artificial Sequence
  Description of Artificial Sequence: Synthetic oligonucleotide
catctaccttcctacgtgtc

SEQ ID NO: 1622 - DNA, 20 bp, Artificial Sequence
  Description of Artificial Sequence: Synthetic oligonucleotide
tgttgttgtgtgcggttgtg

SEQ ID NO: 1623 - DNA, 20 bp, Artificial Sequence
  Description of Artificial Sequence: Synthetic oligonucleotide
gcgtctgaattctcgctccc

SEQ ID NO: 1624 - DNA, 20 bp, Artificial Sequence
  Description of Artificial Sequence: Synthetic oligonucleotide
tatcgtaactcatgcgtgcc

SEQ ID NO: 1625 - DNA, 20 bp, Artificial Sequence
  Description of Artificial Sequence: Synthetic oligonucleotide
agtgtctctgggtttcacgc

SEQ ID NO: 1626 - DNA, 20 bp, Artificial Sequence
  Description of Artificial Sequence: Synthetic oligonucleotide
aattgtgctcctcccatggc

SEQ ID NO: 1627 - DNA, 20 bp, Artificial Sequence
  Description of Artificial Sequence: Synthetic oligonucleotide
ttcccgatccttcccatgtg

SEQ ID NO: 1628 - DNA, 20 bp, Artificial Sequence
  Description of Artificial Sequence: Synthetic oligonucleotide
gttgagtgtgtcatgccccc

SEQ ID NO: 1629 - DNA, 20 bp, Artificial Sequence
  Description of Artificial Sequence: Synthetic oligonucleotide
gaccttagttggacactgtg

SEQ ID NO: 1630 - DNA, 20 bp, Artificial Sequence
  Description of Artificial Sequence: Synthetic oligonucleotide
gtacggttggtttgctgcgc

SEQ ID NO: 1631 - DNA, 20 bp, Artificial Sequence
  Description of Artificial Sequence: Synthetic oligonucleotide
tcactgccactagcaatccg

SEQ ID NO: 1632 - DNA, 20 bp, Artificial Sequence
  Description of Artificial Sequence: Synthetic oligonucleotide
cagtcgtcatgtaccgcgtc

SEQ ID NO: 1633 - DNA, 20 bp, Artificial Sequence
  Description of Artificial Sequence: Synthetic oligonucleotide
tccacgaatagtgcactgcc

SEQ ID NO: 1634 - DNA, 19 bp, Artificial Sequence
  Description of Artificial Sequence: Synthetic oligonucleotide
tttgcgatttctccctggc

SEQ ID NO: 1635 - DNA, 20 bp, Artificial Sequence
  Description of Artificial Sequence: Synthetic oligonucleotide
gaacatggcgtgcctctgtg

SEQ ID NO: 1636 - DNA, 20 bp, Artificial Sequence
  Description of Artificial Sequence: Synthetic oligonucleotide
cccgcaatagtcccagtgcc

SEQ ID NO: 1637 - DNA, 19 bp, Artificial Sequence
  Description of Artificial Sequence: Synthetic oligonucleotide
attggaggtgatgggtccg

SEQ ID NO: 1638 - DNA, 20 bp, Artificial Sequence
  Description of Artificial Sequence: Synthetic oligonucleotide
cttgtcggcttgttcgtccc

SEQ ID NO: 1639 - DNA, 20 bp, Artificial Sequence
  Description of Artificial Sequence: Synthetic oligonucleotide
catcgcgtatcccacgtctg

SEQ ID NO: 1640 - DNA, 20 bp, Artificial Sequence
  Description of Artificial Sequence: Synthetic oligonucleotide
gccatgttagtcatgggggg

SEQ ID NO: 1641 - DNA, 20 bp, Artificial Sequence
  Description of Artificial Sequence: Synthetic oligonucleotide
tttgaagggtgatggggtcg

SEQ ID NO: 1642 - DNA, 20 bp, Artificial Sequence
  Description of Artificial Sequence: Synthetic oligonucleotide
catgtgggttaggccgtctg

SEQ ID NO: 1643 - DNA, 20 bp, Artificial Sequence
  Description of Artificial Sequence: Synthetic oligonucleotide
tcgtgtaagtgtgttgtgtg

SEQ ID NO: 1644 - DNA, 20 bp, Artificial Sequence
  Description of Artificial Sequence: Synthetic oligonucleotide
taccaagcacgttcgttggc

SEQ ID NO: 1645 - DNA, 20 bp, Artificial Sequence
  Description of Artificial Sequence: Synthetic oligonucleotide
tcagatgtaccattggtgtg

SEQ ID NO: 1646 - DNA, 20 bp, Artificial Sequence
  Description of Artificial Sequence: Synthetic oligonucleotide
tgatgtgatggttggtgctg

SEQ ID NO: 1647 - DNA, 20 bp, Artificial Sequence
  Description of Artificial Sequence: Synthetic oligonucleotide
ggtttgagcgtccttgtgtg

SEQ ID NO: 1648 - DNA, 20 bp, Artificial Sequence
  Description of Artificial Sequence: Synthetic oligonucleotide
tgtttgctaataacgctgtg

SEQ ID NO: 1649 - DNA, 20 bp, Artificial Sequence
  Description of Artificial Sequence: Synthetic oligonucleotide
aggcttgtctgccgttggtg

SEQ ID NO: 1650 - DNA, 20 bp, Artificial Sequence
  Description of Artificial Sequence: Synthetic oligonucleotide
aatttggtggaaacgcgctg

SEQ ID NO: 1651 - DNA, 20 bp, Artificial Sequence
  Description of Artificial Sequence: Synthetic oligonucleotide
tttggagggtgatgggtccc

SEQ ID NO: 1652 - DNA, 20 bp, Artificial Sequence
  Description of Artificial Sequence: Synthetic oligonucleotide
tgtagtcttaacccgatggc

SEQ ID NO: 1653 - DNA, 20 bp, Artificial Sequence
  Description of Artificial Sequence: Synthetic oligonucleotide
tgagttgtcccaatctgctg

SEQ ID NO: 1654 - DNA, 20 bp, Artificial Sequence
  Description of Artificial Sequence: Synthetic oligonucleotide
tgcgttacatgattgtgcgc

SEQ ID NO: 1655 - DNA, 20 bp, Artificial Sequence
  Description of Artificial Sequence: Synthetic oligonucleotide
tgactcgtctgcttcgtccc

SEQ ID NO: 1656 - DNA, 20 bp, Artificial Sequence
  Description of Artificial Sequence: Synthetic oligonucleotide
tccttgtacgttctaccccc

SEQ ID NO: 1657 - DNA, 21 bp, Artificial Sequence
  Description of Artificial Sequence: Synthetic oligonucleotide
ttgggtgtagggtggtacccg

SEQ ID NO: 1658 - DNA, 20 bp, Artificial Sequence
  Description of Artificial Sequence: Synthetic oligonucleotide
atactgtttgcgtgctgccc

SEQ ID NO: 1659 - DNA, 20 bp, Artificial Sequence
  Description of Artificial Sequence: Synthetic oligonucleotide
gtcattgttgtctgttgccc

SEQ ID NO: 1660 - DNA, 20 bp, Artificial Sequence
  Description of Artificial Sequence: Synthetic oligonucleotide
accgtatcgtattgtgtgtg

SEQ ID NO: 1661 - DNA, 20 bp, Artificial Sequence
  Description of Artificial Sequence: Synthetic oligonucleotide
tactgtcgtctgttcgtccc

SEQ ID NO: 1662 - DNA, 20 bp, Artificial Sequence
  Description of Artificial Sequence: Synthetic oligonucleotide
tttcctcgtgttcgtgtgtg

SEQ ID NO: 1663 - DNA, 20 bp, Artificial Sequence
  Description of Artificial Sequence: Synthetic oligonucleotide
cgacacgcttaatatggctg

SEQ ID NO: 1664 - DNA, 20 bp, Artificial Sequence
  Description of Artificial Sequence: Synthetic oligonucleotide
cacacgctattccccgtctg

SEQ ID NO: 1665 - DNA, 20 bp, Artificial Sequence
  Description of Artificial Sequence: Synthetic oligonucleotide
tttggtgtagggaggtactg

SEQ ID NO: 1666 - DNA, 20 bp, Artificial Sequence
  Description of Artificial Sequence: Synthetic oligonucleotide
acagtgtgttctgccttgtg

SEQ ID NO: 1667 - DNA, 20 bp, Artificial Sequence
  Description of Artificial Sequence: Synthetic oligonucleotide
aacctctctgtcgttgagtg

SEQ ID NO: 1668 - DNA, 20 bp, Artificial Sequence
  Description of Artificial Sequence: Synthetic oligonucleotide
gtctttcgacgtcttggtac

SEQ ID NO: 1669 - DNA, 19 bp, Artificial Sequence
  Description of Artificial Sequence: Synthetic oligonucleotide
tcactgatgggttgtactg

SEQ ID NO: 1670 - DNA, 20 bp, Artificial Sequence
  Description of Artificial Sequence: Synthetic oligonucleotide
tccatcaacaacttgctccg

SEQ ID NO: 1671 - DNA, 20 bp, Artificial Sequence
  Description of Artificial Sequence: Synthetic oligonucleotide
ttgcattgctcctgcgtgtg

SEQ ID NO: 1672 - DNA, 20 bp, Artificial Sequence
  Description of Artificial Sequence: Synthetic oligonucleotide
tgtaggggggtagttatcgt

SEQ ID NO: 1673 - DNA, 20 bp, Artificial Sequence
  Description of Artificial Sequence: Synthetic oligonucleotide
ttcgaggggtgatgggtccg

SEQ ID NO: 1674 - DNA, 20 bp, Artificial Sequence
  Description of Artificial Sequence: Synthetic oligonucleotide
ttaagtgtagggtggtaccg

SEQ ID NO: 1675 - DNA, 19 bp, Artificial Sequence
  Description of Artificial Sequence: Synthetic oligonucleotide
attggtgaagggaggtacg

SEQ ID NO: 1676 - DNA, 20 bp, Artificial Sequence
  Description of Artificial Sequence: Synthetic oligonucleotide
tttgaagggggatggtaccg

SEQ ID NO: 1677 - DNA, 20 bp, Artificial Sequence
  Description of Artificial Sequence: Synthetic oligonucleotide
ttgggagtagggtggaaccg

SEQ ID NO: 1678 - DNA, 20 bp, Artificial Sequence
  Description of Artificial Sequence: Synthetic oligonucleotide
tttgaagggcgatgagtccg

SEQ ID NO: 1679 - DNA, 20 bp, Artificial Sequence
  Description of Artificial Sequence: Synthetic oligonucleotide
atcagtgtaaagtttgtgtg

SEQ ID NO: 1680 - DNA, 20 bp, Artificial Sequence
  Description of Artificial Sequence: Synthetic oligonucleotide
tcctgtcgtctgtctgtccc

SEQ ID NO: 1681 - DNA, 20 bp, Artificial Sequence
  Description of Artificial Sequence: Synthetic oligonucleotide
tttggtgaagggtggtaccg

SEQ ID NO: 1682 - DNA, 20 bp, Artificial Sequence
  Description of Artificial Sequence: Synthetic oligonucleotide
atagttgtcttgtgtttgtg

SEQ ID NO: 1683 - DNA, 20 bp, Artificial Sequence
  Description of Artificial Sequence: Synthetic oligonucleotide
attgaagggagatgggtccg

SEQ ID NO: 1684 - DNA, 20 bp, Artificial Sequence
  Description of Artificial Sequence: Synthetic oligonucleotide
tggttggtacgagggctgtg

SEQ ID NO: 1685 - DNA, 20 bp, Artificial Sequence
  Description of Artificial Sequence: Synthetic oligonucleotide
tattggcggtgtagggaccg

SEQ ID NO: 1686 - DNA, 20 bp, Artificial Sequence
  Description of Artificial Sequence: Synthetic oligonucleotide
gcttgtcttctgttcgtccc

SEQ ID NO: 1687 - DNA, 20 bp, Artificial Sequence
  Description of Artificial Sequence: Synthetic oligonucleotide
cgtgactttcctccggtcgc

SEQ ID NO: 1688 - DNA, 20 bp, Artificial Sequence
  Description of Artificial Sequence: Synthetic oligonucleotide
gtttccgatggtggtgtggc

SEQ ID NO: 1689 - DNA, 20 bp, Artificial Sequence
  Description of Artificial Sequence: Synthetic oligonucleotide
tttgatgggtgatgggaccg

SEQ ID NO: 1690 - DNA, 19 bp, Artificial Sequence
  Description of Artificial Sequence: Synthetic oligonucleotide
tcaacgttcgtctcctggc

SEQ ID NO: 1691 - DNA, 20 bp, Artificial Sequence
  Description of Artificial Sequence: Synthetic oligonucleotide
tattctcttccctgtcgcac

SEQ ID NO: 1692 - DNA, 20 bp, Artificial Sequence
  Description of Artificial Sequence: Synthetic oligonucleotide
tttggtcctcgccgagtcac

SEQ ID NO: 1693 - DNA, 20 bp, Artificial Sequence
  Description of Artificial Sequence: Synthetic oligonucleotide
ccaccgtgaaaatgtgtgcc

SEQ ID NO: 1694 - DNA, 20 bp, Artificial Sequence
  Description of Artificial Sequence: Synthetic oligonucleotide
tgttccctgcaaatcgtgtg

SEQ ID NO: 1695 - DNA, 20 bp, Artificial Sequence
  Description of Artificial Sequence: Synthetic oligonucleotide
tttgaagggcgatgcgtccg

SEQ ID NO: 1696 - DNA, 20 bp, Artificial Sequence
  Description of Artificial Sequence: Synthetic oligonucleotide
tttggagggtaatgggtccg

SEQ ID NO: 1697 - DNA, 20 bp, Artificial Sequence
  Description of Artificial Sequence: Synthetic oligonucleotide
ttcgattatgcctgccaccc

SEQ ID NO: 1698 - DNA, 20 bp, Artificial Sequence
  Description of Artificial Sequence: Synthetic oligonucleotide
tttcgcattggttgtggctg

SEQ ID NO: 1699 - DNA, 21 bp, Artificial Sequence
  Description of Artificial Sequence: Synthetic oligonucleotide
gtcctgtcgtctgttcgttcc

SEQ ID NO: 1700 - DNA, 20 bp, Artificial Sequence
  Description of Artificial Sequence: Synthetic oligonucleotide
tgttggcactatagctgctg

SEQ ID NO: 1701 - DNA, 20 bp, Artificial Sequence
  Description of Artificial Sequence: Synthetic oligonucleotide
tccaccagttcgactcgtgc

SEQ ID NO: 1702 - DNA, 20 bp, Artificial Sequence
  Description of Artificial Sequence: Synthetic oligonucleotide
gtacacattgatgatggcgc

SEQ ID NO: 1703 - DNA, 20 bp, Artificial Sequence
  Description of Artificial Sequence: Synthetic oligonucleotide
cgtcagatcgttcacgtgtc

SEQ ID NO: 1704 - DNA, 20 bp, Artificial Sequence
  Description of Artificial Sequence: Synthetic oligonucleotide
tttggtgaagggtgggactg

SEQ ID NO: 1705 - DNA, 20 bp, Artificial Sequence
  Description of Artificial Sequence: Synthetic oligonucleotide
attggagaggggaggtactg

SEQ ID NO: 1706 - DNA, 20 bp, Artificial Sequence
  Description of Artificial Sequence: Synthetic oligonucleotide
attggtgaaggggggtgctg

SEQ ID NO: 1707 - DNA, 20 bp, Artificial Sequence
  Description of Artificial Sequence: Synthetic oligonucleotide
ttgggtgcagggtgttaccg

SEQ ID NO: 1708 - DNA, 20 bp, Artificial Sequence
  Description of Artificial Sequence: Synthetic oligonucleotide
tttgctgggtgatgggtccg

SEQ ID NO: 1709 - DNA, 20 bp, Artificial Sequence
  Description of Artificial Sequence: Synthetic oligonucleotide
ttgggggtagggtgggaccg

SEQ ID NO: 1710 - DNA, 19 bp, Artificial Sequence
  Description of Artificial Sequence: Synthetic oligonucleotide
tttgagggggatgggtccg

SEQ ID NO: 1711 - DNA, 18 bp, Artificial Sequence
  Description of Artificial Sequence: Synthetic oligonucleotide
attggtgaagggttactg

SEQ ID NO: 1712 - DNA, 20 bp, Artificial Sequence
  Description of Artificial Sequence: Synthetic oligonucleotide
tttgaagggtggtggggccg

SEQ ID NO: 1713 - DNA, 20 bp, Artificial Sequence
  Description of Artificial Sequence: Synthetic oligonucleotide
ttttaagggagatgggtccg

SEQ ID NO: 1714 - DNA, 20 bp, Artificial Sequence
  Description of Artificial Sequence: Synthetic oligonucleotide
tttgaagggcaatgggtccg

SEQ ID NO: 1715 - DNA, 20 bp, Artificial Sequence
  Description of Artificial Sequence: Synthetic oligonucleotide
gttgaagggcgatgggtccg

SEQ ID NO: 1716 - DNA, 20 bp, Artificial Sequence
  Description of Artificial Sequence: Synthetic oligonucleotide
attggtgaggggtgggactg

SEQ ID NO: 1717 - DNA, 20 bp, Artificial Sequence
  Description of Artificial Sequence: Synthetic oligonucleotide
attggtgaagggcggcactg

SEQ ID NO: 1718 - DNA, 20 bp, Artificial Sequence
  Description of Artificial Sequence: Synthetic oligonucleotide
tttgaaaggagatgggtccg

SEQ ID NO: 1719 - DNA, 20 bp, Artificial Sequence
  Description of Artificial Sequence: Synthetic oligonucleotide
ttgggagtgggatgggaccg

SEQ ID NO: 1720 - DNA, 21 bp, Artificial Sequence
  Description of Artificial Sequence: Synthetic oligonucleotide
gccctttcgttctgccctccc

SEQ ID NO: 1721 - DNA, 20 bp, Artificial Sequence
  Description of Artificial Sequence: Synthetic oligonucleotide
tattggaggtatagggaccg

SEQ ID NO: 1722 - DNA, 21 bp, Artificial Sequence
  Description of Artificial Sequence: Synthetic oligonucleotide
gtcctgtcgtcttttcgtccc

SEQ ID NO: 1723 - DNA, 20 bp, Artificial Sequence
  Description of Artificial Sequence: Synthetic oligonucleotide
attggaggagggtgggaccg

SEQ ID NO: 1724 - DNA, 20 bp, Artificial Sequence
  Description of Artificial Sequence: Synthetic oligonucleotide
tttgaagggtgatgggtatg

SEQ ID NO: 1725 - DNA, 20 bp, Artificial Sequence
  Description of Artificial Sequence: Synthetic oligonucleotide
tttgaagggtgatggggccc

SEQ ID NO: 1726 - DNA, 20 bp, Artificial Sequence
  Description of Artificial Sequence: Synthetic oligonucleotide
tttgccgggtgatgggtccg

SEQ ID NO: 1727 - DNA, 20 bp, Artificial Sequence
  Description of Artificial Sequence: Synthetic oligonucleotide
tttaaagggagatgggtccg

SEQ ID NO: 1728 - DNA, 20 bp, Artificial Sequence
  Description of Artificial Sequence: Synthetic oligonucleotide
ttgggtgtggggtgttaccg

SEQ ID NO: 1729 - DNA, 20 bp, Artificial Sequence
  Description of Artificial Sequence: Synthetic oligonucleotide
tttgaaggccgatgggtccg

SEQ ID NO: 1730 - DNA, 20 bp, Artificial Sequence
  Description of Artificial Sequence: Synthetic oligonucleotide
attggggaagggaggcactg

SEQ ID NO: 1731 - DNA, 18 bp, Artificial Sequence
  Description of Artificial Sequence: Synthetic oligonucleotide
attggtgaagggaggtac

SEQ ID NO: 1732 - DNA, 20 bp, Artificial Sequence
  Description of Artificial Sequence: Synthetic oligonucleotide
attggcgaagggaggaactg

SEQ ID NO: 1733 - DNA, 20 bp, Artificial Sequence
  Description of Artificial Sequence: Synthetic oligonucleotide
ttctccaagtgtcgtgtgtg

SEQ ID NO: 1734 - DNA, 20 bp, Artificial Sequence
  Description of Artificial Sequence: Synthetic oligonucleotide
ttgagtacttgtctgttccc

SEQ ID NO: 1735 - DNA, 20 bp, Artificial Sequence
  Description of Artificial Sequence: Synthetic oligonucleotide
agtgggtcgtattccgtgtg

SEQ ID NO: 1736 - DNA, 20 bp, Artificial Sequence
  Description of Artificial Sequence: Synthetic oligonucleotide
cagcgtctcatcttcgtgtg

SEQ ID NO: 1737 - DNA, 20 bp, Artificial Sequence
  Description of Artificial Sequence: Synthetic oligonucleotide
tcgtttgtttctgctcccca

SEQ ID NO: 1738 - DNA, 20 bp, Artificial Sequence
  Description of Artificial Sequence: Synthetic oligonucleotide
agtccccaactagttgtctg

SEQ ID NO: 1739 - DNA, 19 bp, Artificial Sequence
  Description of Artificial Sequence: Synthetic oligonucleotide
tccgcgtctccttcgtgcc

SEQ ID NO: 1740 - DNA, 20 bp, Artificial Sequence
  Description of Artificial Sequence: Synthetic oligonucleotide
ttcgtcgttcctttcccccc

SEQ ID NO: 1741 - DNA, 20 bp, Artificial Sequence
  Description of Artificial Sequence: Synthetic oligonucleotide
tgagtatttctgttcccccc

SEQ ID NO: 1742 - DNA, 20 bp, Artificial Sequence
  Description of Artificial Sequence: Synthetic oligonucleotide
cagtcgttttaccgcgtgtg

SEQ ID NO: 1743 - DNA, 20 bp, Artificial Sequence
  Description of Artificial Sequence: Synthetic oligonucleotide
tttggaggaggatggtaccg

SEQ ID NO: 1744 - DNA, 20 bp, Artificial Sequence
  Description of Artificial Sequence: Synthetic oligonucleotide
gtgaagttctcttgcgttgc

SEQ ID NO: 1745 - DNA, 20 bp, Artificial Sequence
  Description of Artificial Sequence: Synthetic oligonucleotide
catctgtccagtccggtagc

SEQ ID NO: 1746 - DNA, 20 bp, Artificial Sequence
  Description of Artificial Sequence: Synthetic oligonucleotide
gtcgccttgaatgactgcgc

SEQ ID NO: 1747 - DNA, 20 bp, Artificial Sequence
  Description of Artificial Sequence: Synthetic oligonucleotide
tttatgcctctcacgtgctg

SEQ ID NO: 1748 - DNA, 20 bp, Artificial Sequence
  Description of Artificial Sequence: Synthetic oligonucleotide
acgtcgaactcccgtgtcgc

SEQ ID NO: 1749 - DNA, 20 bp, Artificial Sequence
  Description of Artificial Sequence: Synthetic oligonucleotide
ttgtagtcgttttcattcgc

SEQ ID NO: 1750 - DNA, 20 bp, Artificial Sequence
  Description of Artificial Sequence: Synthetic oligonucleotide
tgcctctgtccgttcgtgtg

SEQ ID NO: 1751 - DNA, 20 bp, Artificial Sequence
  Description of Artificial Sequence: Synthetic oligonucleotide
atggctgttcgttcgctccc

SEQ ID NO: 1752 - DNA, 20 bp, Artificial Sequence
  Description of Artificial Sequence: Synthetic oligonucleotide
gtgaggaaatcattgtgcac

SEQ ID NO: 1753 - DNA, 20 bp, Artificial Sequence
  Description of Artificial Sequence: Synthetic oligonucleotide
tggacgtgttcccgtctgtg

SEQ ID NO: 1754 - DNA, 20 bp, Artificial Sequence
  Description of Artificial Sequence: Synthetic oligonucleotide
tactatcctcccttggtctg

SEQ ID NO: 1755 - DNA, 20 bp, Artificial Sequence
  Description of Artificial Sequence: Synthetic oligonucleotide
tccttcgtcgtttggctcac

SEQ ID NO: 1756 - DNA, 20 bp, Artificial Sequence
  Description of Artificial Sequence: Synthetic oligonucleotide
ctgggtgtagggaggtaccg

SEQ ID NO: 1757 - DNA, 20 bp, Artificial Sequence
  Description of Artificial Sequence: Synthetic oligonucleotide
tagagtgtctcactcctgtg

SEQ ID NO: 1758 - DNA, 20 bp, Artificial Sequence
  Description of Artificial Sequence: Synthetic oligonucleotide
ttactcgtccacattgtgcc

SEQ ID NO: 1759 - DNA, 20 bp, Artificial Sequence
  Description of Artificial Sequence: Synthetic oligonucleotide
caacacgttctcttgtcgtg

SEQ ID NO: 1760 - DNA, 20 bp, Artificial Sequence
  Description of Artificial Sequence: Synthetic oligonucleotide
ttagtcgaggccacttgtgc

SEQ ID NO: 1761 - DNA, 20 bp, Artificial Sequence
  Description of Artificial Sequence: Synthetic oligonucleotide
taaaggtgagggtcgctgtc

SEQ ID NO: 1762 - DNA, 20 bp, Artificial Sequence
  Description of Artificial Sequence: Synthetic oligonucleotide
accctccacagtcgtttggt

SEQ ID NO: 1763 - DNA, 20 bp, Artificial Sequence
  Description of Artificial Sequence: Synthetic oligonucleotide
ccgttcgcttattctccccc

SEQ ID NO: 1764 - DNA, 20 bp, Artificial Sequence
  Description of Artificial Sequence: Synthetic oligonucleotide
tgacttcccagaaccatcgc

SEQ ID NO: 1765 - DNA, 21 bp, Artificial Sequence
  Description of Artificial Sequence: Synthetic oligonucleotide
gccttcgttttggttcgtccc

SEQ ID NO: 1766 - DNA, 20 bp, Artificial Sequence
  Description of Artificial Sequence: Synthetic oligonucleotide
ccgcacattcctccgtggta

SEQ ID NO: 1767 - DNA, 20 bp, Artificial Sequence
  Description of Artificial Sequence: Synthetic oligonucleotide
tataggaggtgtagggaccg

SEQ ID NO: 1768 - DNA, 20 bp, Artificial Sequence
  Description of Artificial Sequence: Synthetic oligonucleotide
ctccgaattccccgtctgcc

SEQ ID NO: 1769 - DNA, 20 bp, Artificial Sequence
  Description of Artificial Sequence: Synthetic oligonucleotide
ggccattgtgttggtgtgtg

SEQ ID NO: 1770 - DNA, 20 bp, Artificial Sequence
  Description of Artificial Sequence: Synthetic oligonucleotide
aaaagggatgactcgtggtg

SEQ ID NO: 1771 - DNA, 20 bp, Artificial Sequence
  Description of Artificial Sequence: Synthetic oligonucleotide
tcagtcgtactgagtctgtc

SEQ ID NO: 1772 - DNA, 20 bp, Artificial Sequence
  Description of Artificial Sequence: Synthetic oligonucleotide
aagtccatcgatcgttggtg

SEQ ID NO: 1773 - DNA, 20 bp, Artificial Sequence
  Description of Artificial Sequence: Synthetic oligonucleotide
aatgaggaggaggtggtgcg

SEQ ID NO: 1774 - DNA, 20 bp, Artificial Sequence
  Description of Artificial Sequence: Synthetic oligonucleotide
cttagttaattgttgttgtg

SEQ ID NO: 1775 - DNA, 20 bp, Artificial Sequence
  Description of Artificial Sequence: Synthetic oligonucleotide
gctgtttcctctgttcccac

SEQ ID NO: 1776 - DNA, 20 bp, Artificial Sequence
  Description of Artificial Sequence: Synthetic oligonucleotide
tgccgaatgtcctgtgaccc

SEQ ID NO: 1777 - DNA, 20 bp, Artificial Sequence
  Description of Artificial Sequence: Synthetic oligonucleotide
atcgctgttctccatgtcct

SEQ ID NO: 1778 - DNA, 20 bp, Artificial Sequence
  Description of Artificial Sequence: Synthetic oligonucleotide
atcctctgatcgtcgatcgc

SEQ ID NO: 1779 - DNA, 20 bp, Artificial Sequence
  Description of Artificial Sequence: Synthetic oligonucleotide
attgactacccttaccgcgt

SEQ ID NO: 1780 - DNA, 20 bp, Artificial Sequence
  Description of Artificial Sequence: Synthetic oligonucleotide
tccttgagttggttaggccc

SEQ ID NO: 1781 - DNA, 20 bp, Artificial Sequence
  Description of Artificial Sequence: Synthetic oligonucleotide
tgccgtttgtaactggtctg

SEQ ID NO: 1782 - DNA, 20 bp, Artificial Sequence
  Description of Artificial Sequence: Synthetic oligonucleotide
gtgacttgtcctgtgttgtg

SEQ ID NO: 1783 - DNA, 20 bp, Artificial Sequence
  Description of Artificial Sequence: Synthetic oligonucleotide
tgacaactcccctgcaactg

SEQ ID NO: 1784 - DNA, 19 bp, Artificial Sequence
  Description of Artificial Sequence: Synthetic oligonucleotide
ttctacgtctgtcccggtg

SEQ ID NO: 1785 - DNA, 20 bp, Artificial Sequence
  Description of Artificial Sequence: Synthetic oligonucleotide
tatccgggaggaacggtgtg

SEQ ID NO: 1786 - DNA, 20 bp, Artificial Sequence
  Description of Artificial Sequence: Synthetic oligonucleotide
gcattgtgatggtgcggctg

SEQ ID NO: 1787 - DNA, 20 bp, Artificial Sequence
  Description of Artificial Sequence: Synthetic oligonucleotide
ttgaatgggtaacactggtg

SEQ ID NO: 1788 - DNA, 20 bp, Artificial Sequence
  Description of Artificial Sequence: Synthetic oligonucleotide
cgtactcgtctattcccccc

SEQ ID NO: 1789 - DNA, 21 bp, Artificial Sequence
  Description of Artificial Sequence: Synthetic oligonucleotide
atcctgtcgtctgttcgtccc

SEQ ID NO: 1790 - DNA, 19 bp, Artificial Sequence
  Description of Artificial Sequence: Synthetic oligonucleotide
ttgggtgtagggagttccg

SEQ ID NO: 1791 - DNA, 19 bp, Artificial Sequence
  Description of Artificial Sequence: Synthetic oligonucleotide
attggtgaagggagtaccg

SEQ ID NO: 1792 - DNA, 20 bp, Artificial Sequence
  Description of Artificial Sequence: Synthetic oligonucleotide
cttgaagggtgatgggcccg

SEQ ID NO: 1793 - DNA, 20 bp, Artificial Sequence
  Description of Artificial Sequence: Synthetic oligonucleotide
acttgtggttatgaccccgc

SEQ ID NO: 1794 - DNA, 20 bp, Artificial Sequence
  Description of Artificial Sequence: Synthetic oligonucleotide
ccttgtttcgtcctgctggc

SEQ ID NO: 1795 - DNA, 20 bp, Artificial Sequence
  Description of Artificial Sequence: Synthetic oligonucleotide
tataactcatgttgtctggc

SEQ ID NO: 1796 - DNA, 20 bp, Artificial Sequence
  Description of Artificial Sequence: Synthetic oligonucleotide
cccgtgcatcgtgtactgtg

SEQ ID NO: 1797 - DNA, 20 bp, Artificial Sequence
  Description of Artificial Sequence: Synthetic oligonucleotide
tttaaagggggatgggtccg

SEQ ID NO: 1798 - DNA, 20 bp, Artificial Sequence
  Description of Artificial Sequence: Synthetic oligonucleotide
ttcctttcgcgcgttgtctg

SEQ ID NO: 1799 - DNA, 20 bp, Artificial Sequence
  Description of Artificial Sequence: Synthetic oligonucleotide
agccgtagtagtctgttgcc

SEQ ID NO: 1800 - DNA, 20 bp, Artificial Sequence
  Description of Artificial Sequence: Synthetic oligonucleotide
tctttctcgtctcctggcgt

SEQ ID NO: 1801 - DNA, 20 bp, Artificial Sequence
  Description of Artificial Sequence: Synthetic oligonucleotide
tgagcgtcagctgttcgcgc

SEQ ID NO: 1802 - DNA, 20 bp, Artificial Sequence
  Description of Artificial Sequence: Synthetic oligonucleotide
caaaacgtccgttctggctg

SEQ ID NO: 1803 - DNA, 20 bp, Artificial Sequence
  Description of Artificial Sequence: Synthetic oligonucleotide
tgtcttccctgcgggttgtc

SEQ ID NO: 1804 - DNA, 20 bp, Artificial Sequence
  Description of Artificial Sequence: Synthetic oligonucleotide
cgtaatgcagtctgtggctg

SEQ ID NO: 1805 - DNA, 20 bp, Artificial Sequence
  Description of Artificial Sequence: Synthetic oligonucleotide
tcatctaggtctcactggcc

SEQ ID NO: 1806 - DNA, 20 bp, Artificial Sequence
  Description of Artificial Sequence: Synthetic oligonucleotide
tttcgtcgtgccgccgtgtg

SEQ ID NO: 1807 - DNA, 20 bp, Artificial Sequence
  Description of Artificial Sequence: Synthetic oligonucleotide
cgatgaattgacgtgttgtg

SEQ ID NO: 1808 - DNA, 20 bp, Artificial Sequence
  Description of Artificial Sequence: Synthetic oligonucleotide
ccagtagtctgttcagtgtg

SEQ ID NO: 1809 - DNA, 20 bp, Artificial Sequence
  Description of Artificial Sequence: Synthetic oligonucleotide
acagtcgggatctgtgtggc

SEQ ID NO: 1810 - DNA, 20 bp, Artificial Sequence
  Description of Artificial Sequence: Synthetic oligonucleotide
tttcaaaagcgtaattgctg

SEQ ID NO: 1811 - DNA, 20 bp, Artificial Sequence
  Description of Artificial Sequence: Synthetic oligonucleotide
attcgctcccatccgttcgc

SEQ ID NO: 1812 - DNA, 21 bp, Artificial Sequence
  Description of Artificial Sequence: Synthetic oligonucleotide
ttgggtgtaggggtggtaccg

SEQ ID NO: 1813 - DNA, 20 bp, Artificial Sequence
  Description of Artificial Sequence: Synthetic oligonucleotide
gtaaacagtcgtcgcccctc

SEQ ID NO: 1814 - DNA, 20 bp, Artificial Sequence
  Description of Artificial Sequence: Synthetic oligonucleotide
tcgatgtcgagttacatccg

SEQ ID NO: 1815 - DNA, 20 bp, Artificial Sequence
  Description of Artificial Sequence: Synthetic oligonucleotide
ccttactgactcccggttgc

SEQ ID NO: 1816 - DNA, 20 bp, Artificial Sequence
  Description of Artificial Sequence: Synthetic oligonucleotide
ttcgggtctgttcgcctgtg

SEQ ID NO: 1817 - DNA, 21 bp, Artificial Sequence
  Description of Artificial Sequence: Synthetic oligonucleotide
tttgaagggtgataggtactg

SEQ ID NO: 1818 - DNA, 20 bp, Artificial Sequence
  Description of Artificial Sequence: Synthetic oligonucleotide
attcgtcactctgctgctgc

SEQ ID NO: 1819 - DNA, 21 bp, Artificial Sequence
  Description of Artificial Sequence: Synthetic oligonucleotide
gtcctgtcgtctgttcgcccc

SEQ ID NO: 1820 - DNA, 20 bp, Artificial Sequence
  Description of Artificial Sequence: Synthetic oligonucleotide
ttgggagggggatggtaccg

SEQ ID NO: 1821 - DNA, 20 bp, Artificial Sequence
  Description of Artificial Sequence: Synthetic oligonucleotide
cagaggagaagggagtttgc

SEQ ID NO: 1822 - DNA, 21 bp, Artificial Sequence
  Description of Artificial Sequence: Synthetic oligonucleotide
cttgtcgtcttgttcgtcccc

SEQ ID NO: 1823 - DNA, 20 bp, Artificial Sequence
  Description of Artificial Sequence: Synthetic oligonucleotide
attggcgaagggagggactg

SEQ ID NO: 1824 - DNA, 20 bp, Artificial Sequence
  Description of Artificial Sequence: Synthetic oligonucleotide
tttgaagggtggtgggtcca

SEQ ID NO: 1825 - DNA, 20 bp, Artificial Sequence
  Description of Artificial Sequence: Synthetic oligonucleotide
tttgaagggtggtgggtacg

SEQ ID NO: 1826 - DNA, 20 bp, Artificial Sequence
  Description of Artificial Sequence: Synthetic oligonucleotide
ttgggtggggggtgggaccg

SEQ ID NO: 1827 - DNA, 20 bp, Artificial Sequence
  Description of Artificial Sequence: Synthetic oligonucleotide
tatacggcggtgtgggggta

SEQ ID NO: 1828 - DNA, 20 bp, Artificial Sequence
  Description of Artificial Sequence: Synthetic oligonucleotide
attggtgaagggtgggaccg

SEQ ID NO: 1829 - DNA, 20 bp, Artificial Sequence
  Description of Artificial Sequence: Synthetic oligonucleotide
tttgaagtttgatgggtccg

SEQ ID NO: 1830 - DNA, 20 bp, Artificial Sequence
  Description of Artificial Sequence: Synthetic oligonucleotide
tgacttgtctgtttcgtccc

SEQ ID NO: 1831 - DNA, 20 bp, Artificial Sequence
  Description of Artificial Sequence: Synthetic oligonucleotide
tttgaagggagatgcgtccg

SEQ ID NO: 1832 - DNA, 19 bp, Artificial Sequence
  Description of Artificial Sequence: Synthetic oligonucleotide
tttgaagggggtgggtccg

SEQ ID NO: 1833 - DNA, 20 bp, Artificial Sequence
  Description of Artificial Sequence: Synthetic oligonucleotide
gtaattgtgtgagccgtccc

SEQ ID NO: 1834 - DNA, 19 bp, Artificial Sequence
  Description of Artificial Sequence: Synthetic oligonucleotide
tgtagggaggtagttatgt

SEQ ID NO: 1835 - DNA, 20 bp, Artificial Sequence
  Description of Artificial Sequence: Synthetic oligonucleotide
cttgtcgccttgttcgtccc

SEQ ID NO: 1836 - DNA, 20 bp, Artificial Sequence
  Description of Artificial Sequence: Synthetic oligonucleotide
ttggaagggtgatgggaccg

SEQ ID NO: 1837 - DNA, 18 bp, Artificial Sequence
  Description of Artificial Sequence: Synthetic oligonucleotide
cggtgtagggtggtaccg

SEQ ID NO: 1838 - DNA, 20 bp, Artificial Sequence
  Description of Artificial Sequence: Synthetic oligonucleotide
cttgtcgtcctgttcgtccc

SEQ ID NO: 1839 - DNA, 20 bp, Artificial Sequence
  Description of Artificial Sequence: Synthetic oligonucleotide
attggtgaaggaagggactg

SEQ ID NO: 1840 - DNA, 20 bp, Artificial Sequence
  Description of Artificial Sequence: Synthetic oligonucleotide
tttgacgggtgatgggcccg

SEQ ID NO: 1841 - DNA, 19 bp, Artificial Sequence
  Description of Artificial Sequence: Synthetic oligonucleotide
cgttcctctggttcgtccc

SEQ ID NO: 1842 - DNA, 20 bp, Artificial Sequence
  Description of Artificial Sequence: Synthetic oligonucleotide
tccgtaacctccccgtgctg

SEQ ID NO: 1843 - DNA, 20 bp, Artificial Sequence
  Description of Artificial Sequence: Synthetic oligonucleotide
tgtagggggaggagggaccg

SEQ ID NO: 1844 - DNA, 20 bp, Artificial Sequence
  Description of Artificial Sequence: Synthetic oligonucleotide
tttgaaggagggtggtaccg

SEQ ID NO: 1845 - DNA, 20 bp, Artificial Sequence
  Description of Artificial Sequence: Synthetic oligonucleotide
ctgatcgtttgggtgtgccc

SEQ ID NO: 1846 - DNA, 20 bp, Artificial Sequence
  Description of Artificial Sequence: Synthetic oligonucleotide
tttgatgggtgttgggtccg

SEQ ID NO: 1847 - DNA, 20 bp, Artificial Sequence
  Description of Artificial Sequence: Synthetic oligonucleotide
ttgggtgcaggggggtaccg

SEQ ID NO: 1848 - DNA, 19 bp, Artificial Sequence
  Description of Artificial Sequence: Synthetic oligonucleotide
tgggtgtagggtgttaccg

SEQ ID NO: 1849 - DNA, 21 bp, Artificial Sequence
  Description of Artificial Sequence: Synthetic oligonucleotide
ttggggtgtagggtggtaccg

SEQ ID NO: 1850 - DNA, 20 bp, Artificial Sequence
  Description of Artificial Sequence: Synthetic oligonucleotide
tttgaagggcgaagggtccg

SEQ ID NO: 1851 - DNA, 20 bp, Artificial Sequence
  Description of Artificial Sequence: Synthetic oligonucleotide
ttgggcgtagggtgggaccg

SEQ ID NO: 1852 - DNA, 20 bp, Artificial Sequence
  Description of Artificial Sequence: Synthetic oligonucleotide
cttgaagggtgatgggtctg

SEQ ID NO: 1853 - DNA, 21 bp, Artificial Sequence
  Description of Artificial Sequence: Synthetic oligonucleotide
tttgaagggtgattgggtcct

SEQ ID NO: 1854 - DNA, 20 bp, Artificial Sequence
  Description of Artificial Sequence: Synthetic oligonucleotide
tttggagggtgatgggtctg

SEQ ID NO: 1855 - DNA, 20 bp, Artificial Sequence
  Description of Artificial Sequence: Synthetic oligonucleotide
tttgaagggggatgggtcct

SEQ ID NO: 1856 - DNA, 20 bp, Artificial Sequence
  Description of Artificial Sequence: Synthetic oligonucleotide
ttcgaagggtgatgggtccc

SEQ ID NO: 1857 - DNA, 20 bp, Artificial Sequence
  Description of Artificial Sequence: Synthetic oligonucleotide
tactcagtcgtcttatactg

SEQ ID NO: 1858 - DNA, 20 bp, Artificial Sequence
  Description of Artificial Sequence: Synthetic oligonucleotide
gtagaatcgtcgcggctgcc

SEQ ID NO: 1859 - DNA, 20 bp, Artificial Sequence
  Description of Artificial Sequence: Synthetic oligonucleotide
tcctggcctgtcgttgtccc

SEQ ID NO: 1860 - DNA, 20 bp, Artificial Sequence
  Description of Artificial Sequence: Synthetic oligonucleotide
atatagtgtgagccgtttgc

SEQ ID NO: 1861 - DNA, 20 bp, Artificial Sequence
  Description of Artificial Sequence: Synthetic oligonucleotide
aagaccgaatgtgtgtgctg

SEQ ID NO: 1862 - DNA, 20 bp, Artificial Sequence
  Description of Artificial Sequence: Synthetic oligonucleotide
tttgaaggttggtgggtccg

SEQ ID NO: 1863 - DNA, 20 bp, Artificial Sequence
  Description of Artificial Sequence: Synthetic oligonucleotide
atgacaattgggtactggtg

SEQ ID NO: 1864 - DNA, 20 bp, Artificial Sequence
  Description of Artificial Sequence: Synthetic oligonucleotide
gattcgatctgtcacctccc

SEQ ID NO: 1865 - DNA, 20 bp, Artificial Sequence
  Description of Artificial Sequence: Synthetic oligonucleotide
gtcgttgtcaaccgtatccc

SEQ ID NO: 1866 - DNA, 20 bp, Artificial Sequence
  Description of Artificial Sequence: Synthetic oligonucleotide
ttcgactagtagttggtcac

SEQ ID NO: 1867 - DNA, 20 bp, Artificial Sequence
  Description of Artificial Sequence: Synthetic oligonucleotide
gcaagttgttgctacccccc

SEQ ID NO: 1868 - DNA, 20 bp, Artificial Sequence
  Description of Artificial Sequence: Synthetic oligonucleotide
ccgtatctaacctccatgtg

SEQ ID NO: 1869 - DNA, 20 bp, Artificial Sequence
  Description of Artificial Sequence: Synthetic oligonucleotide
catagcgtttggcgatgggc

SEQ ID NO: 1870 - DNA, 20 bp, Artificial Sequence
  Description of Artificial Sequence: Synthetic oligonucleotide
tcggtaatcttgtgtagctg

SEQ ID NO: 1871 - DNA, 20 bp, Artificial Sequence
  Description of Artificial Sequence: Synthetic oligonucleotide
gcctttcgttctgctccccc

SEQ ID NO: 1872 - DNA, 20 bp, Artificial Sequence
  Description of Artificial Sequence: Synthetic oligonucleotide
aggtgtgatgaatatggccc

SEQ ID NO: 1873 - DNA, 20 bp, Artificial Sequence
  Description of Artificial Sequence: Synthetic oligonucleotide
tcggagagctaacaacaccg

SEQ ID NO: 1874 - DNA, 20 bp, Artificial Sequence
  Description of Artificial Sequence: Synthetic oligonucleotide
gaacaacaagtcgtcacggc

SEQ ID NO: 1875 - DNA, 20 bp, Artificial Sequence
  Description of Artificial Sequence: Synthetic oligonucleotide
ttgggtgaaggggggtaccg

SEQ ID NO: 1876 - DNA, 20 bp, Artificial Sequence
  Description of Artificial Sequence: Synthetic oligonucleotide
tttggagaagggtggtactg

SEQ ID NO: 1877 - DNA, 20 bp, Artificial Sequence
  Description of Artificial Sequence: Synthetic oligonucleotide
catctaacccagtgtgtgcc

SEQ ID NO: 1878 - DNA, 20 bp, Artificial Sequence
  Description of Artificial Sequence: Synthetic oligonucleotide
acgaagatcgatgctgtgcc

SEQ ID NO: 1879 - DNA, 20 bp, Artificial Sequence
  Description of Artificial Sequence: Synthetic oligonucleotide
gaatagtcggaatgccgcgc

SEQ ID NO: 1880 - DNA, 20 bp, Artificial Sequence
  Description of Artificial Sequence: Synthetic oligonucleotide
agagcgatgtcggtttggcc

SEQ ID NO: 1881 - DNA, 20 bp, Artificial Sequence
  Description of Artificial Sequence: Synthetic oligonucleotide
tcaccgtttcctcctgtgcc

SEQ ID NO: 1882 - DNA, 20 bp, Artificial Sequence
  Description of Artificial Sequence: Synthetic oligonucleotide
ctagtcaggtgtttgggcgc

SEQ ID NO: 1883 - DNA, 20 bp, Artificial Sequence
  Description of Artificial Sequence: Synthetic oligonucleotide
caccataaccgtgcggtctg

SEQ ID NO: 1884 - DNA, 20 bp, Artificial Sequence
  Description of Artificial Sequence: Synthetic oligonucleotide
aatatggcgcccttcacgtg

SEQ ID NO: 1885 - DNA, 20 bp, Artificial Sequence
  Description of Artificial Sequence: Synthetic oligonucleotide
atcagttaacgcacagcctg

SEQ ID NO: 1886 - DNA, 20 bp, Artificial Sequence
  Description of Artificial Sequence: Synthetic oligonucleotide
gtaagaggtcaatgcttggc

SEQ ID NO: 1887 - DNA, 20 bp, Artificial Sequence
  Description of Artificial Sequence: Synthetic oligonucleotide
tcctcgggtatcgatctgtg

SEQ ID NO: 1888 - DNA, 19 bp, Artificial Sequence
  Description of Artificial Sequence: Synthetic oligonucleotide
gcctttcgttcttcctccc

SEQ ID NO: 1889 - DNA, 20 bp, Artificial Sequence
  Description of Artificial Sequence: Synthetic oligonucleotide
gaagcgcctgactatgtgcc

SEQ ID NO: 1890 - DNA, 20 bp, Artificial Sequence
  Description of Artificial Sequence: Synthetic oligonucleotide
aattgttcattctacatgcc

SEQ ID NO: 1891 - DNA, 20 bp, Artificial Sequence
  Description of Artificial Sequence: Synthetic oligonucleotide
gtgattgtacgtcttctccc

SEQ ID NO: 1892 - DNA, 20 bp, Artificial Sequence
  Description of Artificial Sequence: Synthetic oligonucleotide
attggtcaagggaggtaccg

SEQ ID NO: 1893 - DNA, 20 bp, Artificial Sequence
  Description of Artificial Sequence: Synthetic oligonucleotide
gagattgcctgcgccttgtg

SEQ ID NO: 1894 - DNA, 20 bp, Artificial Sequence
  Description of Artificial Sequence: Synthetic oligonucleotide
acgccttattctgcaggcca

SEQ ID NO: 1895 - DNA, 20 bp, Artificial Sequence
  Description of Artificial Sequence: Synthetic oligonucleotide
gagtacgtgtgccgtagctg

SEQ ID NO: 1896 - DNA, 20 bp, Artificial Sequence
  Description of Artificial Sequence: Synthetic oligonucleotide
tatcggtcctagtccagcgc

SEQ ID NO: 1897 - DNA, 20 bp, Artificial Sequence
  Description of Artificial Sequence: Synthetic oligonucleotide
tacgttctctcctgtggccc

SEQ ID NO: 1898 - DNA, 20 bp, Artificial Sequence
  Description of Artificial Sequence: Synthetic oligonucleotide
cagttcgctcccacaagccc

SEQ ID NO: 1899 - DNA, 20 bp, Artificial Sequence
  Description of Artificial Sequence: Synthetic oligonucleotide
tctggggaaataacgtgctg

SEQ ID NO: 1900 - DNA, 20 bp, Artificial Sequence
  Description of Artificial Sequence: Synthetic oligonucleotide
gtcttctgtcttaccgtccc

SEQ ID NO: 1901 - DNA, 20 bp, Artificial Sequence
  Description of Artificial Sequence: Synthetic oligonucleotide
tcccgtcccgtgtatgttgc

SEQ ID NO: 1902 - DNA, 20 bp, Artificial Sequence
  Description of Artificial Sequence: Synthetic oligonucleotide
tagcttgttccccgatgccc

SEQ ID NO: 1903 - DNA, 20 bp, Artificial Sequence
  Description of Artificial Sequence: Synthetic oligonucleotide
ctcagttgtgtggcttgcgc

SEQ ID NO: 1904 - DNA, 20 bp, Artificial Sequence
  Description of Artificial Sequence: Synthetic oligonucleotide
cattcgtttgtgctcgttgc

SEQ ID NO: 1905 - DNA, 20 bp, Artificial Sequence
  Description of Artificial Sequence: Synthetic oligonucleotide
ttgggtgtagggtgggactg

SEQ ID NO: 1906 - DNA, 20 bp, Artificial Sequence
  Description of Artificial Sequence: Synthetic oligonucleotide
cgagcaataactactgtccc

SEQ ID NO: 1907 - DNA, 20 bp, Artificial Sequence
  Description of Artificial Sequence: Synthetic oligonucleotide
attcggcacaccttcctcgc

SEQ ID NO: 1908 - DNA, 20 bp, Artificial Sequence
  Description of Artificial Sequence: Synthetic oligonucleotide
acgagtctgtgacttcgcgc

SEQ ID NO: 1909 - DNA, 20 bp, Artificial Sequence
  Description of Artificial Sequence: Synthetic oligonucleotide
tttgaagggtggtgggtcgg

SEQ ID NO: 1910 - DNA, 20 bp, Artificial Sequence
  Description of Artificial Sequence: Synthetic oligonucleotide
tcctgtcgtctgttcggccc

SEQ ID NO: 1911 - DNA, 19 bp, Artificial Sequence
  Description of Artificial Sequence: Synthetic oligonucleotide
tcctggcttgtcgttgtcc

SEQ ID NO: 1912 - DNA, 20 bp, Artificial Sequence
  Description of Artificial Sequence: Synthetic oligonucleotide
ttcttcccttgcacgtgtgc

SEQ ID NO: 1913 - DNA, 20 bp, Artificial Sequence
  Description of Artificial Sequence: Synthetic oligonucleotide
tttgaagggtgatgggcctg

SEQ ID NO: 1914 - DNA, 19 bp, Artificial Sequence
  Description of Artificial Sequence: Synthetic oligonucleotide
tcctggcttgtgttgtccc

SEQ ID NO: 1915 - DNA, 20 bp, Artificial Sequence
  Description of Artificial Sequence: Synthetic oligonucleotide
ttggccagtagatgttactg

SEQ ID NO: 1916 - DNA, 18 bp, Artificial Sequence
  Description of Artificial Sequence: Synthetic oligonucleotide
tttgaagggtgatgcccg

SEQ ID NO: 1917 - DNA, 20 bp, Artificial Sequence
  Description of Artificial Sequence: Synthetic oligonucleotide
ccaatacgtgattctggccc

SEQ ID NO: 1918 - DNA, 20 bp, Artificial Sequence
  Description of Artificial Sequence: Synthetic oligonucleotide
gtacgtaatttactgtgccc

SEQ ID NO: 1919 - DNA, 20 bp, Artificial Sequence
  Description of Artificial Sequence: Synthetic oligonucleotide
gttcaccaatgaccgatctg

SEQ ID NO: 1920 - DNA, 20 bp, Artificial Sequence
  Description of Artificial Sequence: Synthetic oligonucleotide
gtgcttgtcaggtttaccgc

SEQ ID NO: 1921 - DNA, 21 bp, Artificial Sequence
  Description of Artificial Sequence: Synthetic oligonucleotide
tttgaagggtgatggggggtg

SEQ ID NO: 1922 - DNA, 20 bp, Artificial Sequence
  Description of Artificial Sequence: Synthetic oligonucleotide
aacatcactcccactccccc

SEQ ID NO: 1923 - DNA, 20 bp, Artificial Sequence
  Description of Artificial Sequence: Synthetic oligonucleotide
tatgttgcgctttctctccc

SEQ ID NO: 1924 - DNA, 20 bp, Artificial Sequence
  Description of Artificial Sequence: Synthetic oligonucleotide
tcacggtattctgcgtgccc

SEQ ID NO: 1925 - DNA, 20 bp, Artificial Sequence
  Description of Artificial Sequence: Synthetic oligonucleotide
catagtcgtctttcagcccc

SEQ ID NO: 1926 - DNA, 20 bp, Artificial Sequence
  Description of Artificial Sequence: Synthetic oligonucleotide
cccttcgtcctacgtctgtg

SEQ ID NO: 1927 - DNA, 20 bp, Artificial Sequence
  Description of Artificial Sequence: Synthetic oligonucleotide
gattgggctgatcctgtgtg

SEQ ID NO: 1928 - DNA, 20 bp, Artificial Sequence
  Description of Artificial Sequence: Synthetic oligonucleotide
tctcgttactcccgtccccc

SEQ ID NO: 1929 - DNA, 20 bp, Artificial Sequence
  Description of Artificial Sequence: Synthetic oligonucleotide
cgtagtcatcgacacgtgta

SEQ ID NO: 1930 - DNA, 20 bp, Artificial Sequence
  Description of Artificial Sequence: Synthetic oligonucleotide
agaagtctgtattgcgtggc

SEQ ID NO: 1931 - DNA, 20 bp, Artificial Sequence
  Description of Artificial Sequence: Synthetic oligonucleotide
aaatggcttactgtgtgctg

SEQ ID NO: 1932 - DNA, 20 bp, Artificial Sequence
  Description of Artificial Sequence: Synthetic oligonucleotide
taggtcgctgcatgactgtg

SEQ ID NO: 1933 - DNA, 20 bp, Artificial Sequence
  Description of Artificial Sequence: Synthetic oligonucleotide
tttggggtttccccctgccc

SEQ ID NO: 1934 - DNA, 18 bp, Artificial Sequence
  Description of Artificial Sequence: Synthetic oligonucleotide
tgcgttgcgtttggtttg

SEQ ID NO: 1935 - DNA, 20 bp, Artificial Sequence
  Description of Artificial Sequence: Synthetic oligonucleotide
gttgaagggtgaggggtccg

SEQ ID NO: 1936 - DNA, 20 bp, Artificial Sequence
  Description of Artificial Sequence: Synthetic oligonucleotide
tggttactctctacgctccg

SEQ ID NO: 1937 - DNA, 20 bp, Artificial Sequence
  Description of Artificial Sequence: Synthetic oligonucleotide
gtcattgtttttgtcgtgtg

SEQ ID NO: 1938 - DNA, 20 bp, Artificial Sequence
  Description of Artificial Sequence: Synthetic oligonucleotide
aatctaccttcctgtcgtgc

SEQ ID NO: 1939 - DNA, 20 bp, Artificial Sequence
  Description of Artificial Sequence: Synthetic oligonucleotide
tcttccaaacggtccgtgtg

SEQ ID NO: 1940 - DNA, 20 bp, Artificial Sequence
  Description of Artificial Sequence: Synthetic oligonucleotide
attggagggggatgggactg

SEQ ID NO: 1941 - DNA, 20 bp, Artificial Sequence
  Description of Artificial Sequence: Synthetic oligonucleotide
gccttgcgttctgacctccc

SEQ ID NO: 1942 - DNA, 20 bp, Artificial Sequence
  Description of Artificial Sequence: Synthetic oligonucleotide
tcgatcgtaatgtctggccc

SEQ ID NO: 1943 - DNA, 20 bp, Artificial Sequence
  Description of Artificial Sequence: Synthetic oligonucleotide
ctagtcgaaccgatgctgtc

SEQ ID NO: 1944 - DNA, 20 bp, Artificial Sequence
  Description of Artificial Sequence: Synthetic oligonucleotide
atgaggtaaggaccaccgtg

SEQ ID NO: 1945 - DNA, 20 bp, Artificial Sequence
  Description of Artificial Sequence: Synthetic oligonucleotide
tcgatgtcttccacgtggcc

SEQ ID NO: 1946 - DNA, 20 bp, Artificial Sequence
  Description of Artificial Sequence: Synthetic oligonucleotide
attgctcaggctgtggtggc

SEQ ID NO: 1947 - DNA, 20 bp, Artificial Sequence
  Description of Artificial Sequence: Synthetic oligonucleotide
tttgtcgggtgatgggtccg

SEQ ID NO: 1948 - DNA, 20 bp, Artificial Sequence
  Description of Artificial Sequence: Synthetic oligonucleotide
tttgaagggcgacgggtccg

SEQ ID NO: 1949 - DNA, 20 bp, Artificial Sequence
  Description of Artificial Sequence: Synthetic oligonucleotide
tttgaagggtgatatgtccg

SEQ ID NO: 1950 - DNA, 20 bp, Artificial Sequence
  Description of Artificial Sequence: Synthetic oligonucleotide
tatacggcggtggggggata

SEQ ID NO: 1951 - DNA, 20 bp, Artificial Sequence
  Description of Artificial Sequence: Synthetic oligonucleotide
tcttgtcgtctcttcgtccc

SEQ ID NO: 1952 - DNA, 20 bp, Artificial Sequence
  Description of Artificial Sequence: Synthetic oligonucleotide
tttgaagggggataggtccg

SEQ ID NO: 1953 - DNA, 20 bp, Artificial Sequence
  Description of Artificial Sequence: Synthetic oligonucleotide
attccacattgtcgcgtccc

SEQ ID NO: 1954 - DNA, 20 bp, Artificial Sequence
  Description of Artificial Sequence: Synthetic oligonucleotide
atatcgcctcctaacgtgcc

SEQ ID NO: 1955 - DNA, 20 bp, Artificial Sequence
  Description of Artificial Sequence: Synthetic oligonucleotide
tttgaagggcgatgggtctg

SEQ ID NO: 1956 - DNA, 20 bp, Artificial Sequence
  Description of Artificial Sequence: Synthetic oligonucleotide
acaaatcggctggcgtgcac

SEQ ID NO: 1957 - DNA, 20 bp, Artificial Sequence
  Description of Artificial Sequence: Synthetic oligonucleotide
gacgctacacggggtttgtg

SEQ ID NO: 1958 - DNA, 20 bp, Artificial Sequence
  Description of Artificial Sequence: Synthetic oligonucleotide
tttgaggggtgatgggaccg

SEQ ID NO: 1959 - DNA, 20 bp, Artificial Sequence
  Description of Artificial Sequence: Synthetic oligonucleotide
taccgcacctctacgatccg

SEQ ID NO: 1960 - DNA, 18 bp, Artificial Sequence
  Description of Artificial Sequence: Synthetic oligonucleotide
cgtcgagcttcctgtctg

SEQ ID NO: 1961 - DNA, 20 bp, Artificial Sequence
  Description of Artificial Sequence: Synthetic oligonucleotide
gatgacgttgtcgtggcctc

SEQ ID NO: 1962 - DNA, 20 bp, Artificial Sequence
  Description of Artificial Sequence: Synthetic oligonucleotide
aaccagtaatacccgctccc

SEQ ID NO: 1963 - DNA, 19 bp, Artificial Sequence
  Description of Artificial Sequence: Synthetic oligonucleotide
attggtgaagggagggttg

SEQ ID NO: 1964 - DNA, 20 bp, Artificial Sequence
  Description of Artificial Sequence: Synthetic oligonucleotide
catcgcactgttactgtccc

SEQ ID NO: 1965 - DNA, 20 bp, Artificial Sequence
  Description of Artificial Sequence: Synthetic oligonucleotide
tttgaagggtgatgggtctc

SEQ ID NO: 1966 - DNA, 20 bp, Artificial Sequence
  Description of Artificial Sequence: Synthetic oligonucleotide
tcctcaacgattcgctgcgt

SEQ ID NO: 1967 - DNA, 20 bp, Artificial Sequence
  Description of Artificial Sequence: Synthetic oligonucleotide
acataccgatctcccgtccc

SEQ ID NO: 1968 - DNA, 20 bp, Artificial Sequence
  Description of Artificial Sequence: Synthetic oligonucleotide
attcggcttcctgtgtgcac

SEQ ID NO: 1969 - DNA, 20 bp, Artificial Sequence
  Description of Artificial Sequence: Synthetic oligonucleotide
tatcggtgtcccacggtcgc

SEQ ID NO: 1970 - DNA, 20 bp, Artificial Sequence
  Description of Artificial Sequence: Synthetic oligonucleotide
gtactacttggcatgcggac

SEQ ID NO: 1971 - DNA, 20 bp, Artificial Sequence
  Description of Artificial Sequence: Synthetic oligonucleotide
cctttgtctggtgccgttac

SEQ ID NO: 1972 - DNA, 20 bp, Artificial Sequence
  Description of Artificial Sequence: Synthetic oligonucleotide
gaattcgcttggctagtggc

SEQ ID NO: 1973 - DNA, 20 bp, Artificial Sequence
  Description of Artificial Sequence: Synthetic oligonucleotide
tttgaaggggggtgggtctg

SEQ ID NO: 1974 - DNA, 20 bp, Artificial Sequence
  Description of Artificial Sequence: Synthetic oligonucleotide
agagttgtaactgtggtgtg

SEQ ID NO: 1975 - DNA, 20 bp, Artificial Sequence
  Description of Artificial Sequence: Synthetic oligonucleotide
ttcgcaatgcctttccgccc

SEQ ID NO: 1976 - DNA, 20 bp, Artificial Sequence
  Description of Artificial Sequence: Synthetic oligonucleotide
tgagttctatctgttggccc

SEQ ID NO: 1977 - DNA, 20 bp, Artificial Sequence
  Description of Artificial Sequence: Synthetic oligonucleotide
gttgaagggtgatgggaccg

SEQ ID NO: 1978 - DNA, 20 bp, Artificial Sequence
  Description of Artificial Sequence: Synthetic oligonucleotide
tctagggtcctccgttgctg

SEQ ID NO: 1979 - DNA, 20 bp, Artificial Sequence
  Description of Artificial Sequence: Synthetic oligonucleotide
caaataccttccacccgctg

SEQ ID NO: 1980 - DNA, 20 bp, Artificial Sequence
  Description of Artificial Sequence: Synthetic oligonucleotide
ccgtctcttgacgtgctccc

SEQ ID NO: 1981 - DNA, 20 bp, Artificial Sequence
  Description of Artificial Sequence: Synthetic oligonucleotide
ttgggtgtatggaggtaccg

SEQ ID NO: 1982 - DNA, 20 bp, Artificial Sequence
  Description of Artificial Sequence: Synthetic oligonucleotide
tggtggagtttgtctgtgtg

SEQ ID NO: 1983 - DNA, 20 bp, Artificial Sequence
  Description of Artificial Sequence: Synthetic oligonucleotide
tttgaggggtgatggggccg

SEQ ID NO: 1984 - DNA, 20 bp, Artificial Sequence
  Description of Artificial Sequence: Synthetic oligonucleotide
gttgaagggtgttgggtccg

SEQ ID NO: 1985 - DNA, 20 bp, Artificial Sequence
  Description of Artificial Sequence: Synthetic oligonucleotide
ttgggtggagggaggtaccg

SEQ ID NO: 1986 - DNA, 19 bp, Artificial Sequence
  Description of Artificial Sequence: Synthetic oligonucleotide
ctgaagggtgatgggtccg

SEQ ID NO: 1987 - DNA, 20 bp, Artificial Sequence
  Description of Artificial Sequence: Synthetic oligonucleotide
tttggaggatgatgggaccg

SEQ ID NO: 1988 - DNA, 20 bp, Artificial Sequence
  Description of Artificial Sequence: Synthetic oligonucleotide
tttggtgtagggtgttaccg

SEQ ID NO: 1989 - DNA, 19 bp, Artificial Sequence
  Description of Artificial Sequence: Synthetic oligonucleotide
attgggaagggaggtaccg

SEQ ID NO: 1990 - DNA, 20 bp, Artificial Sequence
  Description of Artificial Sequence: Synthetic oligonucleotide
acggttgctttggcgttggc

SEQ ID NO: 1991 - DNA, 20 bp, Artificial Sequence
  Description of Artificial Sequence: Synthetic oligonucleotide
ccgcaaccttaatcctgccc

SEQ ID NO: 1992 - DNA, 18 bp, Artificial Sequence
  Description of Artificial Sequence: Synthetic oligonucleotide
ttttgggtgatgggtccg

SEQ ID NO: 1993 - DNA, 20 bp, Artificial Sequence
  Description of Artificial Sequence: Synthetic oligonucleotide
cttgaaaggtgatgggtccg

SEQ ID NO: 1994 - DNA, 19 bp, Artificial Sequence
  Description of Artificial Sequence: Synthetic oligonucleotide
ggggtgtagggtggtaccg

SEQ ID NO: 1995 - DNA, 20 bp, Artificial Sequence
  Description of Artificial Sequence: Synthetic oligonucleotide
tttggaggggggagggaccg

SEQ ID NO: 1996 - DNA, 20 bp, Artificial Sequence
  Description of Artificial Sequence: Synthetic oligonucleotide
aattggaggtgtagggaccg

SEQ ID NO: 1997 - DNA, 20 bp, Artificial Sequence
  Description of Artificial Sequence: Synthetic oligonucleotide
tattagaggtgtagggaccg

SEQ ID NO: 1998 - DNA, 20 bp, Artificial Sequence
  Description of Artificial Sequence: Synthetic oligonucleotide
tttgaagggtgatgggcccc

SEQ ID NO: 1999 - DNA, 20 bp, Artificial Sequence
  Description of Artificial Sequence: Synthetic oligonucleotide
gtcttctggcttatcgtcca

SEQ ID NO: 2000 - DNA, 20 bp, Artificial Sequence
  Description of Artificial Sequence: Synthetic oligonucleotide
tcttccgtaatagcgctgcc

SEQ ID NO: 2001 - DNA, 20 bp, Artificial Sequence
  Description of Artificial Sequence: Synthetic oligonucleotide
gccttcgttactctgcactg

SEQ ID NO: 2002 - DNA, 20 bp, Artificial Sequence
  Description of Artificial Sequence: Synthetic oligonucleotide
ctaagtgtcctgccggtctg

SEQ ID NO: 2003 - DNA, 20 bp, Artificial Sequence
  Description of Artificial Sequence: Synthetic oligonucleotide
accctcatgatcttggcctg

SEQ ID NO: 2004 - DNA, 20 bp, Artificial Sequence
  Description of Artificial Sequence: Synthetic oligonucleotide
ttcaccttctgatcgtgccc

SEQ ID NO: 2005 - DNA, 20 bp, Artificial Sequence
  Description of Artificial Sequence: Synthetic oligonucleotide
atgagtcgagttgggggctg

SEQ ID NO: 2006 - DNA, 20 bp, Artificial Sequence
  Description of Artificial Sequence: Synthetic oligonucleotide
tttgttcccccaattgtgcc

SEQ ID NO: 2007 - DNA, 20 bp, Artificial Sequence
  Description of Artificial Sequence: Synthetic oligonucleotide
tgattgtctgctggcttgcc

SEQ ID NO: 2008 - DNA, 20 bp, Artificial Sequence
  Description of Artificial Sequence: Synthetic oligonucleotide
tgcgatcacagtacggcgtg

SEQ ID NO: 2009 - DNA, 20 bp, Artificial Sequence
  Description of Artificial Sequence: Synthetic oligonucleotide
tatcttccgtcgcctgtcac

SEQ ID NO: 2010 - DNA, 20 bp, Artificial Sequence
  Description of Artificial Sequence: Synthetic oligonucleotide
attggtgaagggggggactg

SEQ ID NO: 2011 - DNA, 20 bp, Artificial Sequence
  Description of Artificial Sequence: Synthetic oligonucleotide
atgtcctacccgtcgttggc

SEQ ID NO: 2012 - DNA, 21 bp, Artificial Sequence
  Description of Artificial Sequence: Synthetic oligonucleotide
tcgcattcatccccatgcccc

SEQ ID NO: 2013 - DNA, 20 bp, Artificial Sequence
  Description of Artificial Sequence: Synthetic oligonucleotide
tcttccttgtgtgttcgcgc

SEQ ID NO: 2014 - DNA, 20 bp, Artificial Sequence
  Description of Artificial Sequence: Synthetic oligonucleotide
tatagtgacatgtgttgcgt

SEQ ID NO: 2015 - DNA, 20 bp, Artificial Sequence
  Description of Artificial Sequence: Synthetic oligonucleotide
ttagtcctggtctcgttggc

SEQ ID NO: 2016 - DNA, 20 bp, Artificial Sequence
  Description of Artificial Sequence: Synthetic oligonucleotide
tacagctgaccccgtgtcac

SEQ ID NO: 2017 - DNA, 19 bp, Artificial Sequence
  Description of Artificial Sequence: Synthetic oligonucleotide
tgcgtttcgtctcgcgtcc

SEQ ID NO: 2018 - DNA, 20 bp, Artificial Sequence
  Description of Artificial Sequence: Synthetic oligonucleotide
tttggtggagggtgggactg

SEQ ID NO: 2019 - DNA, 20 bp, Artificial Sequence
  Description of Artificial Sequence: Synthetic oligonucleotide
cctaggagaatgagttgcac

SEQ ID NO: 2020 - DNA, 20 bp, Artificial Sequence
  Description of Artificial Sequence: Synthetic oligonucleotide
gtagcgttatggtgcagtgc

SEQ ID NO: 2021 - DNA, 19 bp, Artificial Sequence
  Description of Artificial Sequence: Synthetic oligonucleotide
tcctgtcgtctgttcgccc

SEQ ID NO: 2022 - DNA, 20 bp, Artificial Sequence
  Description of Artificial Sequence: Synthetic oligonucleotide
tgtcgtagatggttgccggc

SEQ ID NO: 2023 - DNA, 20 bp, Artificial Sequence
  Description of Artificial Sequence: Synthetic oligonucleotide
ctttatactgtaagcaacgg

SEQ ID NO: 2024 - DNA, 20 bp, Artificial Sequence
  Description of Artificial Sequence: Synthetic oligonucleotide
accataccttcttgcccccc

SEQ ID NO: 2025 - DNA, 20 bp, Artificial Sequence
  Description of Artificial Sequence: Synthetic oligonucleotide
cctgcaacttttcgctgctg

SEQ ID NO: 2026 - DNA, 20 bp, Artificial Sequence
  Description of Artificial Sequence: Synthetic oligonucleotide
taggggcaatcgtctatggc

SEQ ID NO: 2027 - DNA, 20 bp, Artificial Sequence
  Description of Artificial Sequence: Synthetic oligonucleotide
accgcttaataatcctgccc

SEQ ID NO: 2028 - DNA, 20 bp, Artificial Sequence
  Description of Artificial Sequence: Synthetic oligonucleotide
tcctaaaatcgttacctgcc

SEQ ID NO: 2029 - DNA, 20 bp, Artificial Sequence
  Description of Artificial Sequence: Synthetic oligonucleotide
cacgtcttctccgtttgcgc

SEQ ID NO: 2030 - DNA, 20 bp, Artificial Sequence
  Description of Artificial Sequence: Synthetic oligonucleotide
atagggagaaaggtgaaccg

SEQ ID NO: 2031 - DNA, 20 bp, Artificial Sequence
  Description of Artificial Sequence: Synthetic oligonucleotide
gtaagttgtcagcctctcgc

SEQ ID NO: 2032 - DNA, 20 bp, Artificial Sequence
  Description of Artificial Sequence: Synthetic oligonucleotide
tttgagtggtgatgggtccg

SEQ ID NO: 2033 - DNA, 19 bp, Artificial Sequence
  Description of Artificial Sequence: Synthetic oligonucleotide
tgtgctttatgcctggccc

SEQ ID NO: 2034 - DNA, 20 bp, Artificial Sequence
  Description of Artificial Sequence: Synthetic oligonucleotide
gttttctggcttatcgtccc

SEQ ID NO: 2035 - DNA, 20 bp, Artificial Sequence
  Description of Artificial Sequence: Synthetic oligonucleotide
ggatgatgttagtttggcgc

SEQ ID NO: 2036 - DNA, 20 bp, Artificial Sequence
  Description of Artificial Sequence: Synthetic oligonucleotide
gtaagacgtccacatacgtg

SEQ ID NO: 2037 - DNA, 20 bp, Artificial Sequence
  Description of Artificial Sequence: Synthetic oligonucleotide
cgtttcctctggttcgtcct

SEQ ID NO: 2038 - DNA, 20 bp, Artificial Sequence
  Description of Artificial Sequence: Synthetic oligonucleotide
aatcctcaaaagtgcgtgta

SEQ ID NO: 2039 - DNA, 20 bp, Artificial Sequence
  Description of Artificial Sequence: Synthetic oligonucleotide
atactgagtcgtaagttgtg

SEQ ID NO: 2040 - DNA, 20 bp, Artificial Sequence
  Description of Artificial Sequence: Synthetic oligonucleotide
tcggctcgtctcgtgatccc

SEQ ID NO: 2041 - DNA, 19 bp, Artificial Sequence
  Description of Artificial Sequence: Synthetic oligonucleotide
ttgaagggtgatgggtccc

SEQ ID NO: 2042 - DNA, 20 bp, Artificial Sequence
  Description of Artificial Sequence: Synthetic oligonucleotide
tggcgttttgagcggctgtg

SEQ ID NO: 2043 - DNA, 20 bp, Artificial Sequence
  Description of Artificial Sequence: Synthetic oligonucleotide
tttgaagggtgttgggcccg

SEQ ID NO: 2044 - DNA, 20 bp, Artificial Sequence
  Description of Artificial Sequence: Synthetic oligonucleotide
cactttcgttctgacctccc

SEQ ID NO: 2045 - DNA, 20 bp, Artificial Sequence
  Description of Artificial Sequence: Synthetic oligonucleotide
tcctcagtgttatggtgcgc

SEQ ID NO: 2046 - DNA, 20 bp, Artificial Sequence
  Description of Artificial Sequence: Synthetic oligonucleotide
ttgtatgtacgacggtgctg

SEQ ID NO: 2047 - DNA, 20 bp, Artificial Sequence
  Description of Artificial Sequence: Synthetic oligonucleotide
gctaagacactcatgtgccg

SEQ ID NO: 2048 - DNA, 20 bp, Artificial Sequence
  Description of Artificial Sequence: Synthetic oligonucleotide
tggtttgactgtctgtgccc

SEQ ID NO: 2049 - DNA, 20 bp, Artificial Sequence
  Description of Artificial Sequence: Synthetic oligonucleotide
tctgtcctctgtgcactccc

SEQ ID NO: 2050 - DNA, 20 bp, Artificial Sequence
  Description of Artificial Sequence: Synthetic oligonucleotide
gatcaactggaacacgtggc

SEQ ID NO: 2051 - DNA, 20 bp, Artificial Sequence
  Description of Artificial Sequence: Synthetic oligonucleotide
tatgaaggaagtgcccactg

SEQ ID NO: 2052 - DNA, 20 bp, Artificial Sequence
  Description of Artificial Sequence: Synthetic oligonucleotide
ttttggtccatcctgctgcc

SEQ ID NO: 2053 - DNA, 20 bp, Artificial Sequence
  Description of Artificial Sequence: Synthetic oligonucleotide
tccttgtcgtcttacgtccc

SEQ ID NO: 2054 - DNA, 20 bp, Artificial Sequence
  Description of Artificial Sequence: Synthetic oligonucleotide
tcgtcaacaaaatgtgacgc

SEQ ID NO: 2055 - DNA, 20 bp, Artificial Sequence
  Description of Artificial Sequence: Synthetic oligonucleotide
ttcccgctaaccagtacccc

SEQ ID NO: 2056 - DNA, 20 bp, Artificial Sequence
  Description of Artificial Sequence: Synthetic oligonucleotide
tgctggtggtttcgcggctg

SEQ ID NO: 2057 - DNA, 20 bp, Artificial Sequence
  Description of Artificial Sequence: Synthetic oligonucleotide
gtctacgtcgtcagctgcac

SEQ ID NO: 2058 - DNA, 20 bp, Artificial Sequence
  Description of Artificial Sequence: Synthetic oligonucleotide
ttcctgtcgtcgatttgcgc

SEQ ID NO: 2059 - DNA, 20 bp, Artificial Sequence
  Description of Artificial Sequence: Synthetic oligonucleotide
gatgagtatcaggcctgcgc

SEQ ID NO: 2060 - DNA, 20 bp, Artificial Sequence
  Description of Artificial Sequence: Synthetic oligonucleotide
tctatagtcatatcggtgcc

SEQ ID NO: 2061 - DNA, 20 bp, Artificial Sequence
  Description of Artificial Sequence: Synthetic oligonucleotide
agctggacacttggggtctg

SEQ ID NO: 2062 - DNA, 20 bp, Artificial Sequence
  Description of Artificial Sequence: Synthetic oligonucleotide
tccgcgttgctctcgcacac

SEQ ID NO: 2063 - DNA, 20 bp, Artificial Sequence
  Description of Artificial Sequence: Synthetic oligonucleotide
gttgtcctttgcttccgcac

SEQ ID NO: 2064 - DNA, 20 bp, Artificial Sequence
  Description of Artificial Sequence: Synthetic oligonucleotide
aaatcgtcatttagtgtgtc

SEQ ID NO: 2065 - DNA, 20 bp, Artificial Sequence
  Description of Artificial Sequence: Synthetic oligonucleotide
cagaggagaagggaggttcc

SEQ ID NO: 2066 - DNA, 20 bp, Artificial Sequence
  Description of Artificial Sequence: Synthetic oligonucleotide
tcgtgttcgttttgcatgtg

SEQ ID NO: 2067 - DNA, 20 bp, Artificial Sequence
  Description of Artificial Sequence: Synthetic oligonucleotide
tttgaagggagatggctccg

SEQ ID NO: 2068 - DNA, 20 bp, Artificial Sequence
  Description of Artificial Sequence: Synthetic oligonucleotide
cgacaagtctgtaccctccc

SEQ ID NO: 2069 - DNA, 20 bp, Artificial Sequence
  Description of Artificial Sequence: Synthetic oligonucleotide
tttgaaaggcgatgggtccg

SEQ ID NO: 2070 - DNA, 20 bp, Artificial Sequence
  Description of Artificial Sequence: Synthetic oligonucleotide
tttgtagggtgttgggtccg

SEQ ID NO: 2071 - DNA, 20 bp, Artificial Sequence
  Description of Artificial Sequence: Synthetic oligonucleotide
tttgacgggtggtgggtccg

SEQ ID NO: 2072 - DNA, 20 bp, Artificial Sequence
  Description of Artificial Sequence: Synthetic oligonucleotide
agagttaatctgtctgtggc

SEQ ID NO: 2073 - DNA, 20 bp, Artificial Sequence
  Description of Artificial Sequence: Synthetic oligonucleotide
tattggaagtgtagggaccg

SEQ ID NO: 2074 - DNA, 18 bp, Artificial Sequence
  Description of Artificial Sequence: Synthetic oligonucleotide
attggaagggaggtactg

SEQ ID NO: 2075 - DNA, 20 bp, Artificial Sequence
  Description of Artificial Sequence: Synthetic oligonucleotide
ccgtccatgttacacctctc

SEQ ID NO: 2076 - DNA, 20 bp, Artificial Sequence
  Description of Artificial Sequence: Synthetic oligonucleotide
ttgggggtatggtggtaccg

SEQ ID NO: 2077 - DNA, 20 bp, Artificial Sequence
  Description of Artificial Sequence: Synthetic oligonucleotide
cacacgcgttatgtctaccc

SEQ ID NO: 2078 - DNA, 20 bp, Artificial Sequence
  Description of Artificial Sequence: Synthetic oligonucleotide
ccgtaatagtccctgatccc

SEQ ID NO: 2079 - DNA, 20 bp, Artificial Sequence
  Description of Artificial Sequence: Synthetic oligonucleotide
atcatcaggctgtataccgc

SEQ ID NO: 2080 - DNA, 20 bp, Artificial Sequence
  Description of Artificial Sequence: Synthetic oligonucleotide
ttgtctaccttctactgccg

SEQ ID NO: 2081 - DNA, 20 bp, Artificial Sequence
  Description of Artificial Sequence: Synthetic oligonucleotide
tctgaagggagatgggtccg

SEQ ID NO: 2082 - DNA, 20 bp, Artificial Sequence
  Description of Artificial Sequence: Synthetic oligonucleotide
acactacaaaatggtcgctg

SEQ ID NO: 2083 - DNA, 20 bp, Artificial Sequence
  Description of Artificial Sequence: Synthetic oligonucleotide
gacggaggtgtcgtcgtgtg

SEQ ID NO: 2084 - DNA, 20 bp, Artificial Sequence
  Description of Artificial Sequence: Synthetic oligonucleotide
attgaagggtggtgggtccg

SEQ ID NO: 2085 - DNA, 20 bp, Artificial Sequence
  Description of Artificial Sequence: Synthetic oligonucleotide
gattggaggtgtagggaccg

SEQ ID NO: 2086 - DNA, 20 bp, Artificial Sequence
  Description of Artificial Sequence: Synthetic oligonucleotide
accccaatgtagtctgtggc

SEQ ID NO: 2087 - DNA, 20 bp, Artificial Sequence
  Description of Artificial Sequence: Synthetic oligonucleotide
agtcgtctttcgagcctgac

SEQ ID NO: 2088 - DNA, 20 bp, Artificial Sequence
  Description of Artificial Sequence: Synthetic oligonucleotide
attgtgaatggagccggctg

SEQ ID NO: 2089 - DNA, 20 bp, Artificial Sequence
  Description of Artificial Sequence: Synthetic oligonucleotide
cagtcctgtcgtcgtgtagc

SEQ ID NO: 2090 - DNA, 20 bp, Artificial Sequence
  Description of Artificial Sequence: Synthetic oligonucleotide
tttgaagggggatgagtccg

SEQ ID NO: 2091 - DNA, 20 bp, Artificial Sequence
  Description of Artificial Sequence: Synthetic oligonucleotide
gatgagtccaaccccgtgtg

SEQ ID NO: 2092 - DNA, 20 bp, Artificial Sequence
  Description of Artificial Sequence: Synthetic oligonucleotide
tttgatggggggtgggaccg

SEQ ID NO: 2093 - DNA, 20 bp, Artificial Sequence
  Description of Artificial Sequence: Synthetic oligonucleotide
gtgctcttgtctctcgtgtg

SEQ ID NO: 2094 - DNA, 19 bp, Artificial Sequence
  Description of Artificial Sequence: Synthetic oligonucleotide
tcgaagggtgatgggtccg

SEQ ID NO: 2095 - DNA, 20 bp, Artificial Sequence
  Description of Artificial Sequence: Synthetic oligonucleotide
atttgcgttctctcgagccg

SEQ ID NO: 2096 - DNA, 20 bp, Artificial Sequence
  Description of Artificial Sequence: Synthetic oligonucleotide
acactggagaacctgtgccc

SEQ ID NO: 2097 - DNA, 20 bp, Artificial Sequence
  Description of Artificial Sequence: Synthetic oligonucleotide
ttcgattggtccccagtccg

SEQ ID NO: 2098 - DNA, 20 bp, Artificial Sequence
  Description of Artificial Sequence: Synthetic oligonucleotide
ttcgtttgtcccggctgcgt

SEQ ID NO: 2099 - DNA, 20 bp, Artificial Sequence
  Description of Artificial Sequence: Synthetic oligonucleotide
caaagcgcctccaacagtac

SEQ ID NO: 2100 - DNA, 20 bp, Artificial Sequence
  Description of Artificial Sequence: Synthetic oligonucleotide
atccaagggtaaaccaggtg

SEQ ID NO: 2101 - DNA, 20 bp, Artificial Sequence
  Description of Artificial Sequence: Synthetic oligonucleotide
taacatgcgtaccccctccc

SEQ ID NO: 2102 - DNA, 20 bp, Artificial Sequence
  Description of Artificial Sequence: Synthetic oligonucleotide
ttgggtggagggcggtaccg

SEQ ID NO: 2103 - DNA, 20 bp, Artificial Sequence
  Description of Artificial Sequence: Synthetic oligonucleotide
tccgaataatattgcgccgc

SEQ ID NO: 2104 - DNA, 19 bp, Artificial Sequence
  Description of Artificial Sequence: Synthetic oligonucleotide
tcctgtgtctttgcgtccc

SEQ ID NO: 2105 - DNA, 20 bp, Artificial Sequence
  Description of Artificial Sequence: Synthetic oligonucleotide
ctgggtgtagggcggtaccg

SEQ ID NO: 2106 - DNA, 20 bp, Artificial Sequence
  Description of Artificial Sequence: Synthetic oligonucleotide
taggaaacctccttgcgtgc

SEQ ID NO: 2107 - DNA, 20 bp, Artificial Sequence
  Description of Artificial Sequence: Synthetic oligonucleotide
atagggagaagggtgagccg

SEQ ID NO: 2108 - DNA, 20 bp, Artificial Sequence
  Description of Artificial Sequence: Synthetic oligonucleotide
gtggcctgttcctctgtccg

SEQ ID NO: 2109 - DNA, 20 bp, Artificial Sequence
  Description of Artificial Sequence: Synthetic oligonucleotide
caaacggttaaactagcgtg

SEQ ID NO: 2110 - DNA, 20 bp, Artificial Sequence
  Description of Artificial Sequence: Synthetic oligonucleotide
caatagataagcccggtgcc

SEQ ID NO: 2111 - DNA, 20 bp, Artificial Sequence
  Description of Artificial Sequence: Synthetic oligonucleotide
tccttgctctgctgtatgcc

SEQ ID NO: 2112 - DNA, 20 bp, Artificial Sequence
  Description of Artificial Sequence: Synthetic oligonucleotide
acagtcctcttggttgcccc

SEQ ID NO: 2113 - DNA, 20 bp, Artificial Sequence
  Description of Artificial Sequence: Synthetic oligonucleotide
tgtaggaggaggtgggaccg

SEQ ID NO: 2114 - DNA, 20 bp, Artificial Sequence
  Description of Artificial Sequence: Synthetic oligonucleotide
tacctcctagtggtggtccc

SEQ ID NO: 2115 - DNA, 20 bp, Artificial Sequence
  Description of Artificial Sequence: Synthetic oligonucleotide
atcaaccttcctgacgtgtg

SEQ ID NO: 2116 - DNA, 20 bp, Artificial Sequence
  Description of Artificial Sequence: Synthetic oligonucleotide
tcaactcacaaacctgtcgc

SEQ ID NO: 2117 - DNA, 20 bp, Artificial Sequence
  Description of Artificial Sequence: Synthetic oligonucleotide
attggagaagggaggaactg

SEQ ID NO: 2118 - DNA, 20 bp, Artificial Sequence
  Description of Artificial Sequence: Synthetic oligonucleotide
ttgggagcagggtggtaccg

SEQ ID NO: 2119 - DNA, 20 bp, Artificial Sequence
  Description of Artificial Sequence: Synthetic oligonucleotide
attggtggagggtgggactg

SEQ ID NO: 2120 - DNA, 20 bp, Artificial Sequence
  Description of Artificial Sequence: Synthetic oligonucleotide
ttgggagtatggtggtaccg

SEQ ID NO: 2121 - DNA, 20 bp, Artificial Sequence
  Description of Artificial Sequence: Synthetic oligonucleotide
tttgaagggagatgggttcg

SEQ ID NO: 2122 - DNA, 20 bp, Artificial Sequence
  Description of Artificial Sequence: Synthetic oligonucleotide
caccgtcgctgtttacgccc

SEQ ID NO: 2123 - DNA, 20 bp, Artificial Sequence
  Description of Artificial Sequence: Synthetic oligonucleotide
cttgaagggtgttgggtccg

SEQ ID NO: 2124 - DNA, 20 bp, Artificial Sequence
  Description of Artificial Sequence: Synthetic oligonucleotide
tttgaagggtgagggggccg

SEQ ID NO: 2125 - DNA, 20 bp, Artificial Sequence
  Description of Artificial Sequence: Synthetic oligonucleotide
acgaacaatgggggttgccc

SEQ ID NO: 2126 - DNA, 20 bp, Artificial Sequence
  Description of Artificial Sequence: Synthetic oligonucleotide
tttggagaaggatgggaccg

SEQ ID NO: 2127 - DNA, 21 bp, Artificial Sequence
  Description of Artificial Sequence: Synthetic oligonucleotide
ttttgaagggagatgggtccg

SEQ ID NO: 2128 - DNA, 19 bp, Artificial Sequence
  Description of Artificial Sequence: Synthetic oligonucleotide
atgaagggtgatgggtccg

SEQ ID NO: 2129 - DNA, 20 bp, Artificial Sequence
  Description of Artificial Sequence: Synthetic oligonucleotide
tttgaagggcgatcggtccg

SEQ ID NO: 2130 - DNA, 20 bp, Artificial Sequence
  Description of Artificial Sequence: Synthetic oligonucleotide
tttgaagggagatgggtcgg

SEQ ID NO: 2131 - DNA, 20 bp, Artificial Sequence
  Description of Artificial Sequence: Synthetic oligonucleotide
cttgtcgttttgttcgtccc

SEQ ID NO: 2132 - DNA, 18 bp, Artificial Sequence
  Description of Artificial Sequence: Synthetic oligonucleotide
atttggagaagggaggtg

SEQ ID NO: 2133 - DNA, 20 bp, Artificial Sequence
  Description of Artificial Sequence: Synthetic oligonucleotide
attccctccgttctcgttac

SEQ ID NO: 2134 - DNA, 20 bp, Artificial Sequence
  Description of Artificial Sequence: Synthetic oligonucleotide
tttaaagggtggtgggtccg

SEQ ID NO: 2135 - DNA, 20 bp, Artificial Sequence
  Description of Artificial Sequence: Synthetic oligonucleotide
tttgaagggtgatggttccc

SEQ ID NO: 2136 - DNA, 18 bp, Artificial Sequence
  Description of Artificial Sequence: Synthetic oligonucleotide
gcttcgttctgacctccc

SEQ ID NO: 2137 - DNA, 20 bp, Artificial Sequence
  Description of Artificial Sequence: Synthetic oligonucleotide
ttggaaggagggtggtaccg

SEQ ID NO: 2138 - DNA, 20 bp, Artificial Sequence
  Description of Artificial Sequence: Synthetic oligonucleotide
tttgaagtgcgatgggtccg

SEQ ID NO: 2139 - DNA, 20 bp, Artificial Sequence
  Description of Artificial Sequence: Synthetic oligonucleotide
ttggaaggaggatgggaccg

SEQ ID NO: 2140 - DNA, 20 bp, Artificial Sequence
  Description of Artificial Sequence: Synthetic oligonucleotide
taaaccgtccatcctgtccc

SEQ ID NO: 2141 - DNA, 20 bp, Artificial Sequence
  Description of Artificial Sequence: Synthetic oligonucleotide
ttctccatcgttgtgcgcca

SEQ ID NO: 2142 - DNA, 20 bp, Artificial Sequence
  Description of Artificial Sequence: Synthetic oligonucleotide
tttggagggggatggtaccg

SEQ ID NO: 2143 - DNA, 20 bp, Artificial Sequence
  Description of Artificial Sequence: Synthetic oligonucleotide
caagtcgctgttttcctgcc

SEQ ID NO: 2144 - DNA, 20 bp, Artificial Sequence
  Description of Artificial Sequence: Synthetic oligonucleotide
ttgggaggagggtgggtccg

SEQ ID NO: 2145 - DNA, 20 bp, Artificial Sequence
  Description of Artificial Sequence: Synthetic oligonucleotide
cttgaagtgtgatgggtccg

SEQ ID NO: 2146 - DNA, 20 bp, Artificial Sequence
  Description of Artificial Sequence: Synthetic oligonucleotide
gttgaagtgtgatgggtccg

SEQ ID NO: 2147 - DNA, 20 bp, Artificial Sequence
  Description of Artificial Sequence: Synthetic oligonucleotide
ttgtgtgtaggggggtaccg

SEQ ID NO: 2148 - DNA, 18 bp, Artificial Sequence
  Description of Artificial Sequence: Synthetic oligonucleotide
tttgaagggtgaggggtg

SEQ ID NO: 2149 - DNA, 20 bp, Artificial Sequence
  Description of Artificial Sequence: Synthetic oligonucleotide
attgggagaagggtgaaccg

SEQ ID NO: 2150 - DNA, 21 bp, Artificial Sequence
  Description of Artificial Sequence: Synthetic oligonucleotide
agatcgatgggttctcgtgcc

SEQ ID NO: 2151 - DNA, 20 bp, Artificial Sequence
  Description of Artificial Sequence: Synthetic oligonucleotide
caagtcgtccttggtgtgtg

SEQ ID NO: 2152 - DNA, 20 bp, Artificial Sequence
  Description of Artificial Sequence: Synthetic oligonucleotide
tatctaggcgcctatgactg

SEQ ID NO: 2153 - DNA, 20 bp, Artificial Sequence
  Description of Artificial Sequence: Synthetic oligonucleotide
tgtagtcggtgcattgtggc

SEQ ID NO: 2154 - DNA, 20 bp, Artificial Sequence
  Description of Artificial Sequence: Synthetic oligonucleotide
ccttgtcgtctgttcgtccc

SEQ ID NO: 2155 - DNA, 20 bp, Artificial Sequence
  Description of Artificial Sequence: Synthetic oligonucleotide
caaaaaagtaaatgtcactg

SEQ ID NO: 2156 - DNA, 20 bp, Artificial Sequence
  Description of Artificial Sequence: Synthetic oligonucleotide
tgagtctaagtatgtggctg

SEQ ID NO: 2157 - DNA, 20 bp, Artificial Sequence
  Description of Artificial Sequence: Synthetic oligonucleotide
tccttgtcgtcttgcgtccg

SEQ ID NO: 2158 - DNA, 19 bp, Artificial Sequence
  Description of Artificial Sequence: Synthetic oligonucleotide
ctattggtggagggtggtg

SEQ ID NO: 2159 - DNA, 20 bp, Artificial Sequence
  Description of Artificial Sequence: Synthetic oligonucleotide
tagtagttaatcctgtgccc

SEQ ID NO: 2160 - DNA, 19 bp, Artificial Sequence
  Description of Artificial Sequence: Synthetic oligonucleotide
gcaactaagcctccgtgac

SEQ ID NO: 2161 - DNA, 20 bp, Artificial Sequence
  Description of Artificial Sequence: Synthetic oligonucleotide
gtttcaaggtaacgtctggc

SEQ ID NO: 2162 - DNA, 20 bp, Artificial Sequence
  Description of Artificial Sequence: Synthetic oligonucleotide
catcggtgctccgtcgtata

SEQ ID NO: 2163 - DNA, 20 bp, Artificial Sequence
  Description of Artificial Sequence: Synthetic oligonucleotide
ttgggtggggggtggtaccg

SEQ ID NO: 2164 - DNA, 20 bp, Artificial Sequence
  Description of Artificial Sequence: Synthetic oligonucleotide
gcgttcaccgtcggtctgtg

SEQ ID NO: 2165 - DNA, 20 bp, Artificial Sequence
  Description of Artificial Sequence: Synthetic oligonucleotide
ttagacatgacaggccgcgc

SEQ ID NO: 2166 - DNA, 20 bp, Artificial Sequence
  Description of Artificial Sequence: Synthetic oligonucleotide
gattcgtgctggcatatgtc

SEQ ID NO: 2167 - DNA, 20 bp, Artificial Sequence
  Description of Artificial Sequence: Synthetic oligonucleotide
aaaagtccttgagtgtgccc

SEQ ID NO: 2168 - DNA, 20 bp, Artificial Sequence
  Description of Artificial Sequence: Synthetic oligonucleotide
tgttcccctggatcgttggc

SEQ ID NO: 2169 - DNA, 20 bp, Artificial Sequence
  Description of Artificial Sequence: Synthetic oligonucleotide
gattcgtccccgatcgttgg

SEQ ID NO: 2170 - DNA, 21 bp, Artificial Sequence
  Description of Artificial Sequence: Synthetic oligonucleotide
taccgtcgtttttggcttggc

SEQ ID NO: 2171 - DNA, 20 bp, Artificial Sequence
  Description of Artificial Sequence: Synthetic oligonucleotide
ccctgtgaaaatgtgctgtg

SEQ ID NO: 2172 - DNA, 18 bp, Artificial Sequence
  Description of Artificial Sequence: Synthetic oligonucleotide
ttggcttgtcgttgtccc

SEQ ID NO: 2173 - DNA, 20 bp, Artificial Sequence
  Description of Artificial Sequence: Synthetic oligonucleotide
tccagctcctttcacctccc

SEQ ID NO: 2174 - DNA, 20 bp, Artificial Sequence
  Description of Artificial Sequence: Synthetic oligonucleotide
cgtgctcatacggtctggcc

SEQ ID NO: 2175 - DNA, 20 bp, Artificial Sequence
  Description of Artificial Sequence: Synthetic oligonucleotide
aaatcagtgtgccgcgacac

SEQ ID NO: 2176 - DNA, 20 bp, Artificial Sequence
  Description of Artificial Sequence: Synthetic oligonucleotide
attcggtaaagttacgtctg

SEQ ID NO: 2177 - DNA, 20 bp, Artificial Sequence
  Description of Artificial Sequence: Synthetic oligonucleotide
gccaaatgtcctctgcgcgc

SEQ ID NO: 2178 - DNA, 20 bp, Artificial Sequence
  Description of Artificial Sequence: Synthetic oligonucleotide
aatcgttacttatcgctggt

SEQ ID NO: 2179 - DNA, 20 bp, Artificial Sequence
  Description of Artificial Sequence: Synthetic oligonucleotide
aatgatatcctcattacgtg

SEQ ID NO: 2180 - DNA, 20 bp, Artificial Sequence
  Description of Artificial Sequence: Synthetic oligonucleotide
tctggcaacatgctccaccc

SEQ ID NO: 2181 - DNA, 20 bp, Artificial Sequence
  Description of Artificial Sequence: Synthetic oligonucleotide
aggacggtgttcggtcagta

SEQ ID NO: 2182 - DNA, 20 bp, Artificial Sequence
  Description of Artificial Sequence: Synthetic oligonucleotide
gagcgatgatatgacatccg

SEQ ID NO: 2183 - DNA, 20 bp, Artificial Sequence
  Description of Artificial Sequence: Synthetic oligonucleotide
ttgggtggagggtgttaccg

SEQ ID NO: 2184 - DNA, 20 bp, Artificial Sequence
  Description of Artificial Sequence: Synthetic oligonucleotide
atacgatcctccaggtgccc

SEQ ID NO: 2185 - DNA, 20 bp, Artificial Sequence
  Description of Artificial Sequence: Synthetic oligonucleotide
catccgtccggcgtacatgc

SEQ ID NO: 2186 - DNA, 20 bp, Artificial Sequence
  Description of Artificial Sequence: Synthetic oligonucleotide
tcacccttggctttccaccg

SEQ ID NO: 2187 - DNA, 20 bp, Artificial Sequence
  Description of Artificial Sequence: Synthetic oligonucleotide
cgttgcgatctgtccgtgtg

SEQ ID NO: 2188 - DNA, 20 bp, Artificial Sequence
  Description of Artificial Sequence: Synthetic oligonucleotide
gtgcgtcatgtctgtctgcc

SEQ ID NO: 2189 - DNA, 20 bp, Artificial Sequence
  Description of Artificial Sequence: Synthetic oligonucleotide
ttgggtgcagggaggtaccg

SEQ ID NO: 2190 - DNA, 20 bp, Artificial Sequence
  Description of Artificial Sequence: Synthetic oligonucleotide
ctaagaggaggagatgggag

SEQ ID NO: 2191 - DNA, 20 bp, Artificial Sequence
  Description of Artificial Sequence: Synthetic oligonucleotide
catcgtgcactccgcgtgtc

SEQ ID NO: 2192 - DNA, 20 bp, Artificial Sequence
  Description of Artificial Sequence: Synthetic oligonucleotide
ttagctgcgcacagcatgcc

SEQ ID NO: 2193 - DNA, 20 bp, Artificial Sequence
  Description of Artificial Sequence: Synthetic oligonucleotide
tcttccattagcgcagtgcc

SEQ ID NO: 2194 - DNA, 20 bp, Artificial Sequence
  Description of Artificial Sequence: Synthetic oligonucleotide
aacaagcctctccgttgccc

SEQ ID NO: 2195 - DNA, 20 bp, Artificial Sequence
  Description of Artificial Sequence: Synthetic oligonucleotide
taagcacgataatccccccc

SEQ ID NO: 2196 - DNA, 20 bp, Artificial Sequence
  Description of Artificial Sequence: Synthetic oligonucleotide
gattgggtcgtcccactgtg

SEQ ID NO: 2197 - DNA, 20 bp, Artificial Sequence
  Description of Artificial Sequence: Synthetic oligonucleotide
cttgcgttatggcgttgtgc

SEQ ID NO: 2198 - DNA, 20 bp, Artificial Sequence
  Description of Artificial Sequence: Synthetic oligonucleotide
ttgagtgtagggtgttaccg

SEQ ID NO: 2199 - DNA, 20 bp, Artificial Sequence
  Description of Artificial Sequence: Synthetic oligonucleotide
aaccatggcttccccgtgtc

SEQ ID NO: 2200 - DNA, 20 bp, Artificial Sequence
  Description of Artificial Sequence: Synthetic oligonucleotide
gtttggtaagcgcctctgtg

SEQ ID NO: 2201 - DNA, 20 bp, Artificial Sequence
  Description of Artificial Sequence: Synthetic oligonucleotide
ataactgggtactctggccg

SEQ ID NO: 2202 - DNA, 20 bp, Artificial Sequence
  Description of Artificial Sequence: Synthetic oligonucleotide
agtcgctgatgttgtcgctg

SEQ ID NO: 2203 - DNA, 20 bp, Artificial Sequence
  Description of Artificial Sequence: Synthetic oligonucleotide
tctgtccgggtctgtcgcta

SEQ ID NO: 2204 - DNA, 20 bp, Artificial Sequence
  Description of Artificial Sequence: Synthetic oligonucleotide
acggctattaagctactcgc

SEQ ID NO: 2205 - DNA, 20 bp, Artificial Sequence
  Description of Artificial Sequence: Synthetic oligonucleotide
gtagtgctctggtacgcggc

SEQ ID NO: 2206 - DNA, 20 bp, Artificial Sequence
  Description of Artificial Sequence: Synthetic oligonucleotide
aaagaacacctcatcttgtc

SEQ ID NO: 2207 - DNA, 20 bp, Artificial Sequence
  Description of Artificial Sequence: Synthetic oligonucleotide
tattcgagcacatacgtgtg

SEQ ID NO: 2208 - DNA, 20 bp, Artificial Sequence
  Description of Artificial Sequence: Synthetic oligonucleotide
acctccaataatatgtgcgc

SEQ ID NO: 2209 - DNA, 20 bp, Artificial Sequence
  Description of Artificial Sequence: Synthetic oligonucleotide
gtgacggtgccttgagtgtg

SEQ ID NO: 2210 - DNA, 20 bp, Artificial Sequence
  Description of Artificial Sequence: Synthetic oligonucleotide
tctaaactctcctgcacctg

SEQ ID NO: 2211 - DNA, 20 bp, Artificial Sequence
  Description of Artificial Sequence: Synthetic oligonucleotide
acgagcgagtatgtgcgcac

SEQ ID NO: 2212 - DNA, 20 bp, Artificial Sequence
  Description of Artificial Sequence: Synthetic oligonucleotide
tatccggaacgtgctgtcgc

SEQ ID NO: 2213 - DNA, 20 bp, Artificial Sequence
  Description of Artificial Sequence: Synthetic oligonucleotide
tctaaagtgcactgtgtccc

SEQ ID NO: 2214 - DNA, 19 bp, Artificial Sequence
  Description of Artificial Sequence: Synthetic oligonucleotide
tcttgtcgtcttgcgtccc

SEQ ID NO: 2215 - DNA, 20 bp, Artificial Sequence
  Description of Artificial Sequence: Synthetic oligonucleotide
tacgaaagaacaatcttgtg

SEQ ID NO: 2216 - DNA, 20 bp, Artificial Sequence
  Description of Artificial Sequence: Synthetic oligonucleotide
gaatagtgtgtgtggttggc

SEQ ID NO: 2217 - DNA, 20 bp, Artificial Sequence
  Description of Artificial Sequence: Synthetic oligonucleotide
cgttcaccctgtcgtttggc

SEQ ID NO: 2218 - DNA, 21 bp, Artificial Sequence
  Description of Artificial Sequence: Synthetic oligonucleotide
gtcctgtcgtctgttcttccc

SEQ ID NO: 2219 - DNA, 20 bp, Artificial Sequence
  Description of Artificial Sequence: Synthetic oligonucleotide
atgtctatggctacacgggc

SEQ ID NO: 2220 - DNA, 20 bp, Artificial Sequence
  Description of Artificial Sequence: Synthetic oligonucleotide
taccgagagttcttcaccgc

SEQ ID NO: 2221 - DNA, 20 bp, Artificial Sequence
  Description of Artificial Sequence: Synthetic oligonucleotide
ccatgttaacagtcactccc

SEQ ID NO: 2222 - DNA, 20 bp, Artificial Sequence
  Description of Artificial Sequence: Synthetic oligonucleotide
tcacagtagcatgccgtccc

SEQ ID NO: 2223 - DNA, 20 bp, Artificial Sequence
  Description of Artificial Sequence: Synthetic oligonucleotide
ccgtgtcgtctgttcgtccc

SEQ ID NO: 2224 - DNA, 20 bp, Artificial Sequence
  Description of Artificial Sequence: Synthetic oligonucleotide
tccattcccgttaacggccg

SEQ ID NO: 2225 - DNA, 20 bp, Artificial Sequence
  Description of Artificial Sequence: Synthetic oligonucleotide
tacctcggcttctgtgtgca

SEQ ID NO: 2226 - DNA, 20 bp, Artificial Sequence
  Description of Artificial Sequence: Synthetic oligonucleotide
tgtggttgtctggtgatgtg

SEQ ID NO: 2227 - DNA, 20 bp, Artificial Sequence
  Description of Artificial Sequence: Synthetic oligonucleotide
acggcgcgttgtctcgtcac

SEQ ID NO: 2228 - DNA, 20 bp, Artificial Sequence
  Description of Artificial Sequence: Synthetic oligonucleotide
gtgattgttgaggtctggcc

SEQ ID NO: 2229 - DNA, 20 bp, Artificial Sequence
  Description of Artificial Sequence: Synthetic oligonucleotide
tcatttattccgtctgtgcc

SEQ ID NO: 2230 - DNA, 20 bp, Artificial Sequence
  Description of Artificial Sequence: Synthetic oligonucleotide
gtacgtgaactcgttgtggc

SEQ ID NO: 2231 - DNA, 20 bp, Artificial Sequence
  Description of Artificial Sequence: Synthetic oligonucleotide
cataagtgagtgtgagcccc

SEQ ID NO: 2232 - DNA, 20 bp, Artificial Sequence
  Description of Artificial Sequence: Synthetic oligonucleotide
tgtaattagtttgtactgtg

SEQ ID NO: 2233 - DNA, 20 bp, Artificial Sequence
  Description of Artificial Sequence: Synthetic oligonucleotide
tttcacgtcatgcctgtgtc

SEQ ID NO: 2234 - DNA, 20 bp, Artificial Sequence
  Description of Artificial Sequence: Synthetic oligonucleotide
ttagcttgacgtgccgcgtg

SEQ ID NO: 2235 - DNA, 20 bp, Artificial Sequence
  Description of Artificial Sequence: Synthetic oligonucleotide
tcctttcgagtattcgtctg

SEQ ID NO: 2236 - DNA, 20 bp, Artificial Sequence
  Description of Artificial Sequence: Synthetic oligonucleotide
tttgatgggtgatgggtccc

SEQ ID NO: 2237 - DNA, 20 bp, Artificial Sequence
  Description of Artificial Sequence: Synthetic oligonucleotide
cctgcaacattgtgccatac

SEQ ID NO: 2238 - DNA, 20 bp, Artificial Sequence
  Description of Artificial Sequence: Synthetic oligonucleotide
atacattgtgactaccgtgc

SEQ ID NO: 2239 - DNA, 20 bp, Artificial Sequence
  Description of Artificial Sequence: Synthetic oligonucleotide
accttaacaattctgcggcc

SEQ ID NO: 2240 - DNA, 20 bp, Artificial Sequence
  Description of Artificial Sequence: Synthetic oligonucleotide
tttgaagggtgataggtccc

SEQ ID NO: 2241 - DNA, 20 bp, Artificial Sequence
  Description of Artificial Sequence: Synthetic oligonucleotide
aaacacctcctatgcgtgac

SEQ ID NO: 2242 - DNA, 20 bp, Artificial Sequence
  Description of Artificial Sequence: Synthetic oligonucleotide
tcgtcgcgtaactctgcctg

SEQ ID NO: 2243 - DNA, 20 bp, Artificial Sequence
  Description of Artificial Sequence: Synthetic oligonucleotide
cccagtagtctgcacctgta

SEQ ID NO: 2244 - DNA, 20 bp, Artificial Sequence
  Description of Artificial Sequence: Synthetic oligonucleotide
acactccattaagcctcctg

SEQ ID NO: 2245 - DNA, 20 bp, Artificial Sequence
  Description of Artificial Sequence: Synthetic oligonucleotide
tctgcgtatcgtttgtgccc

SEQ ID NO: 2246 - DNA, 20 bp, Artificial Sequence
  Description of Artificial Sequence: Synthetic oligonucleotide
cgatggttctcttcagtgtg

SEQ ID NO: 2247 - DNA, 20 bp, Artificial Sequence
  Description of Artificial Sequence: Synthetic oligonucleotide
atagccgatctttgccacgt

SEQ ID NO: 2248 - DNA, 20 bp, Artificial Sequence
  Description of Artificial Sequence: Synthetic oligonucleotide
attggtgaagggaggtaacg

SEQ ID NO: 2249 - DNA, 20 bp, Artificial Sequence
  Description of Artificial Sequence: Synthetic oligonucleotide
cgattcacctggctccgcac

SEQ ID NO: 2250 - DNA, 20 bp, Artificial Sequence
  Description of Artificial Sequence: Synthetic oligonucleotide
ttgatcatcctcgctgcgtg

SEQ ID NO: 2251 - DNA, 20 bp, Artificial Sequence
  Description of Artificial Sequence: Synthetic oligonucleotide
ctctagttcctcctgtgtgc

SEQ ID NO: 2252 - DNA, 20 bp, Artificial Sequence
  Description of Artificial Sequence: Synthetic oligonucleotide
accgtgtctgtggtgtggtg

SEQ ID NO: 2253 - DNA, 20 bp, Artificial Sequence
  Description of Artificial Sequence: Synthetic oligonucleotide
ataagtggttgtagtcgtgc

SEQ ID NO: 2254 - DNA, 20 bp, Artificial Sequence
  Description of Artificial Sequence: Synthetic oligonucleotide
tatcaattggaatggtgcgc

SEQ ID NO: 2255 - DNA, 20 bp, Artificial Sequence
  Description of Artificial Sequence: Synthetic oligonucleotide
tgactcgtctatttcgtccc

SEQ ID NO: 2256 - DNA, 20 bp, Artificial Sequence
  Description of Artificial Sequence: Synthetic oligonucleotide
ttcgtgggctatgacgcgcc

SEQ ID NO: 2257 - DNA, 20 bp, Artificial Sequence
  Description of Artificial Sequence: Synthetic oligonucleotide
gaacatgtaacaaggtgctg

SEQ ID NO: 2258 - DNA, 20 bp, Artificial Sequence
  Description of Artificial Sequence: Synthetic oligonucleotide
ttcgtgtatctgggtgctac

SEQ ID NO: 2259 - DNA, 20 bp, Artificial Sequence
  Description of Artificial Sequence: Synthetic oligonucleotide
cgtttcctctggttcgtcca

SEQ ID NO: 2260 - DNA, 19 bp, Artificial Sequence
  Description of Artificial Sequence: Synthetic oligonucleotide
gcgaagggtgatgggtccg

SEQ ID NO: 2261 - DNA, 20 bp, Artificial Sequence
  Description of Artificial Sequence: Synthetic oligonucleotide
tggtctacgcgtatcgtgtg

SEQ ID NO: 2262 - DNA, 20 bp, Artificial Sequence
  Description of Artificial Sequence: Synthetic oligonucleotide
tttgaagggcgatgggtcgg

SEQ ID NO: 2263 - DNA, 20 bp, Artificial Sequence
  Description of Artificial Sequence: Synthetic oligonucleotide
tgactcgtccgtttcgtccc

SEQ ID NO: 2264 - DNA, 20 bp, Artificial Sequence
  Description of Artificial Sequence: Synthetic oligonucleotide
aactccttctctcggctcgc

SEQ ID NO: 2265 - DNA, 18 bp, Artificial Sequence
  Description of Artificial Sequence: Synthetic oligonucleotide
tttgaagtgatgggtccg

SEQ ID NO: 2266 - DNA, 20 bp, Artificial Sequence
  Description of Artificial Sequence: Synthetic oligonucleotide
tattggaggtgtagggacct

SEQ ID NO: 2267 - DNA, 19 bp, Artificial Sequence
  Description of Artificial Sequence: Synthetic oligonucleotide
tttttgggtgatgggtccg

SEQ ID NO: 2268 - DNA, 20 bp, Artificial Sequence
  Description of Artificial Sequence: Synthetic oligonucleotide
tattgtaggtgtagggaccg

SEQ ID NO: 2269 - DNA, 20 bp, Artificial Sequence
  Description of Artificial Sequence: Synthetic oligonucleotide
tttgaagggggacgggtccg

SEQ ID NO: 2270 - DNA, 20 bp, Artificial Sequence
  Description of Artificial Sequence: Synthetic oligonucleotide
tgagtccctaggtatgcccc

SEQ ID NO: 2271 - DNA, 20 bp, Artificial Sequence
  Description of Artificial Sequence: Synthetic oligonucleotide
cttgaagggtgatgagtccg

SEQ ID NO: 2272 - DNA, 20 bp, Artificial Sequence
  Description of Artificial Sequence: Synthetic oligonucleotide
ttgggtgttgggtgttaccg

SEQ ID NO: 2273 - DNA, 19 bp, Artificial Sequence
  Description of Artificial Sequence: Synthetic oligonucleotide
ttggtgtagggtggtactg

SEQ ID NO: 2274 - DNA, 20 bp, Artificial Sequence
  Description of Artificial Sequence: Synthetic oligonucleotide
agagtctatgagtgtgaccc

SEQ ID NO: 2275 - DNA, 20 bp, Artificial Sequence
  Description of Artificial Sequence: Synthetic oligonucleotide
tttgaaggcggatgggtccg

SEQ ID NO: 2276 - DNA, 20 bp, Artificial Sequence
  Description of Artificial Sequence: Synthetic oligonucleotide
ttatgttcaagtgacgtggc

SEQ ID NO: 2277 - DNA, 20 bp, Artificial Sequence
  Description of Artificial Sequence: Synthetic oligonucleotide
ggcggtaaacacgctgtggc

SEQ ID NO: 2278 - DNA, 20 bp, Artificial Sequence
  Description of Artificial Sequence: Synthetic oligonucleotide
tgcgtcatctggttcatggc

SEQ ID NO: 2279 - DNA, 20 bp, Artificial Sequence
  Description of Artificial Sequence: Synthetic oligonucleotide
gtcgagatcgactcgtttgc

SEQ ID NO: 2280 - DNA, 20 bp, Artificial Sequence
  Description of Artificial Sequence: Synthetic oligonucleotide
ttgggtgtatggcggtaccg

SEQ ID NO: 2281 - DNA, 20 bp, Artificial Sequence
  Description of Artificial Sequence: Synthetic oligonucleotide
ccattcgagctggcagtgcc

SEQ ID NO: 2282 - DNA, 18 bp, Artificial Sequence
  Description of Artificial Sequence: Synthetic oligonucleotide
tttgaaggatgatgtccg

SEQ ID NO: 2283 - DNA, 20 bp, Artificial Sequence
  Description of Artificial Sequence: Synthetic oligonucleotide
tggccgtaaaagtgtggccc

SEQ ID NO: 2284 - DNA, 20 bp, Artificial Sequence
  Description of Artificial Sequence: Synthetic oligonucleotide
ttcactgtagtatccactac

SEQ ID NO: 2285 - DNA, 20 bp, Artificial Sequence
  Description of Artificial Sequence: Synthetic oligonucleotide
ttgggtgaagggtggcaccg

SEQ ID NO: 2286 - DNA, 20 bp, Artificial Sequence
  Description of Artificial Sequence: Synthetic oligonucleotide
tatcgtattgtttatcccac

SEQ ID NO: 2287 - DNA, 19 bp, Artificial Sequence
  Description of Artificial Sequence: Synthetic oligonucleotide
gctttcgttcagccctccc

SEQ ID NO: 2288 - DNA, 20 bp, Artificial Sequence
  Description of Artificial Sequence: Synthetic oligonucleotide
caagtcattagggctgttgc

SEQ ID NO: 2289 - DNA, 20 bp, Artificial Sequence
  Description of Artificial Sequence: Synthetic oligonucleotide
tgtgttgtctgtctggggtc

SEQ ID NO: 2290 - DNA, 20 bp, Artificial Sequence
  Description of Artificial Sequence: Synthetic oligonucleotide
tccttgttgtcttgcgtccc

SEQ ID NO: 2291 - DNA, 20 bp, Artificial Sequence
  Description of Artificial Sequence: Synthetic oligonucleotide
tgtaaagtcgtcccgtgccc

SEQ ID NO: 2292 - DNA, 20 bp, Artificial Sequence
  Description of Artificial Sequence: Synthetic oligonucleotide
ttgggaggaggatgggtccg

SEQ ID NO: 2293 - DNA, 20 bp, Artificial Sequence
  Description of Artificial Sequence: Synthetic oligonucleotide
tgttgctatggactgtgccg

SEQ ID NO: 2294 - DNA, 20 bp, Artificial Sequence
  Description of Artificial Sequence: Synthetic oligonucleotide
cacagtgagtgatgccggta

SEQ ID NO: 2295 - DNA, 21 bp, Artificial Sequence
  Description of Artificial Sequence: Synthetic oligonucleotide
ttttggggttttcccgtgccc

SEQ ID NO: 2296 - DNA, 20 bp, Artificial Sequence
  Description of Artificial Sequence: Synthetic oligonucleotide
tgtagggaggtagttatccg

SEQ ID NO: 2297 - DNA, 20 bp, Artificial Sequence
  Description of Artificial Sequence: Synthetic oligonucleotide
gatcctcctaattgcgccgc

SEQ ID NO: 2298 - DNA, 19 bp, Artificial Sequence
  Description of Artificial Sequence: Synthetic oligonucleotide
ttgaagggtgatgggcccg

SEQ ID NO: 2299 - DNA, 20 bp, Artificial Sequence
  Description of Artificial Sequence: Synthetic oligonucleotide
gaagttgcgctgcacgtgtc

SEQ ID NO: 2300 - DNA, 20 bp, Artificial Sequence
  Description of Artificial Sequence: Synthetic oligonucleotide
ttggaagtgggatgggaccg

SEQ ID NO: 2301 - DNA, 20 bp, Artificial Sequence
  Description of Artificial Sequence: Synthetic oligonucleotide
ctggatatactcctgatccc

SEQ ID NO: 2302 - DNA, 20 bp, Artificial Sequence
  Description of Artificial Sequence: Synthetic oligonucleotide
ttgggtgtaggatgggaccg

SEQ ID NO: 2303 - DNA, 20 bp, Artificial Sequence
  Description of Artificial Sequence: Synthetic oligonucleotide
ctaacgatgatacaggtcca

SEQ ID NO: 2304 - DNA, 20 bp, Artificial Sequence
  Description of Artificial Sequence: Synthetic oligonucleotide
acggatgactagacccactg

SEQ ID NO: 2305 - DNA, 20 bp, Artificial Sequence
  Description of Artificial Sequence: Synthetic oligonucleotide
catgaccacactcctgtccc

SEQ ID NO: 2306 - DNA, 20 bp, Artificial Sequence
  Description of Artificial Sequence: Synthetic oligonucleotide
attggcgaagggcggtactg

SEQ ID NO: 2307 - DNA, 20 bp, Artificial Sequence
  Description of Artificial Sequence: Synthetic oligonucleotide
ttgtctgtgtggattgcgta

SEQ ID NO: 2308 - DNA, 20 bp, Artificial Sequence
  Description of Artificial Sequence: Synthetic oligonucleotide
aacatcgtgtcgaagctccc

SEQ ID NO: 2309 - DNA, 20 bp, Artificial Sequence
  Description of Artificial Sequence: Synthetic oligonucleotide
ctcatcaccatactgtcgtg

SEQ ID NO: 2310 - DNA, 20 bp, Artificial Sequence
  Description of Artificial Sequence: Synthetic oligonucleotide
aagtccaatcttttgcgcgc

SEQ ID NO: 2311 - DNA, 20 bp, Artificial Sequence
  Description of Artificial Sequence: Synthetic oligonucleotide
tctcctagtaatttgtcgtc

SEQ ID NO: 2312 - DNA, 20 bp, Artificial Sequence
  Description of Artificial Sequence: Synthetic oligonucleotide
tcgagagtcagccacttcgc

SEQ ID NO: 2313 - DNA, 20 bp, Artificial Sequence
  Description of Artificial Sequence: Synthetic oligonucleotide
gttgaagggtgatggggccg

SEQ ID NO: 2314 - DNA, 20 bp, Artificial Sequence
  Description of Artificial Sequence: Synthetic oligonucleotide
ttggatgtagggtgggaccg

SEQ ID NO: 2315 - DNA, 20 bp, Artificial Sequence
  Description of Artificial Sequence: Synthetic oligonucleotide
tttgaagggggatcggtccg

SEQ ID NO: 2316 - DNA, 18 bp, Artificial Sequence
  Description of Artificial Sequence: Synthetic oligonucleotide
aatgaacgtcctatgctg

SEQ ID NO: 2317 - DNA, 20 bp, Artificial Sequence
  Description of Artificial Sequence: Synthetic oligonucleotide
tctctggacaacccggttgc

SEQ ID NO: 2318 - DNA, 20 bp, Artificial Sequence
  Description of Artificial Sequence: Synthetic oligonucleotide
taggcaacatggacatgctg

SEQ ID NO: 2319 - DNA, 20 bp, Artificial Sequence
  Description of Artificial Sequence: Synthetic oligonucleotide
ttgggaggggggtgggtccg

SEQ ID NO: 2320 - DNA, 20 bp, Artificial Sequence
  Description of Artificial Sequence: Synthetic oligonucleotide
ttggggttggagatggactg

SEQ ID NO: 2321 - DNA, 21 bp, Artificial Sequence
  Description of Artificial Sequence: Synthetic oligonucleotide
tattggaggtgtaggggaccg

SEQ ID NO: 2322 - DNA, 20 bp, Artificial Sequence
  Description of Artificial Sequence: Synthetic oligonucleotide
cattcatagtctcccgtggc

SEQ ID NO: 2323 - DNA, 20 bp, Artificial Sequence
  Description of Artificial Sequence: Synthetic oligonucleotide
cgctagacctacatgctgcc

SEQ ID NO: 2324 - DNA, 20 bp, Artificial Sequence
  Description of Artificial Sequence: Synthetic oligonucleotide
tgcgatgtaagctggtgcgc

SEQ ID NO: 2325 - DNA, 20 bp, Artificial Sequence
  Description of Artificial Sequence: Synthetic oligonucleotide
ttcctctactccctagcgta

SEQ ID NO: 2326 - DNA, 20 bp, Artificial Sequence
  Description of Artificial Sequence: Synthetic oligonucleotide
atatcgtctccttcgctctg

SEQ ID NO: 2327 - DNA, 20 bp, Artificial Sequence
  Description of Artificial Sequence: Synthetic oligonucleotide
tattggagatgtagggaccg

SEQ ID NO: 2328 - DNA, 20 bp, Artificial Sequence
  Description of Artificial Sequence: Synthetic oligonucleotide
ccattgtccttgatgtaccg

SEQ ID NO: 2329 - DNA, 20 bp, Artificial Sequence
  Description of Artificial Sequence: Synthetic oligonucleotide
tccgaagggtgatgggtccg

SEQ ID NO: 2330 - DNA, 20 bp, Artificial Sequence
  Description of Artificial Sequence: Synthetic oligonucleotide
aaccacgatgctgccagccg

SEQ ID NO: 2331 - DNA, 20 bp, Artificial Sequence
  Description of Artificial Sequence: Synthetic oligonucleotide
attggaggagggagggaccg

SEQ ID NO: 2332 - DNA, 20 bp, Artificial Sequence
  Description of Artificial Sequence: Synthetic oligonucleotide
attggtggggggagggactg

SEQ ID NO: 2333 - DNA, 20 bp, Artificial Sequence
  Description of Artificial Sequence: Synthetic oligonucleotide
gattcaaggccccgcgtgtg

SEQ ID NO: 2334 - DNA, 20 bp, Artificial Sequence
  Description of Artificial Sequence: Synthetic oligonucleotide
tgcagggaggtagttatcgt

SEQ ID NO: 2335 - DNA, 20 bp, Artificial Sequence
  Description of Artificial Sequence: Synthetic oligonucleotide
tttggagtggggtggtaccg

SEQ ID NO: 2336 - DNA, 20 bp, Artificial Sequence
  Description of Artificial Sequence: Synthetic oligonucleotide
attcgtgctcattccgcccc

SEQ ID NO: 2337 - DNA, 20 bp, Artificial Sequence
  Description of Artificial Sequence: Synthetic oligonucleotide
tgtagggtggtagttatcgt

SEQ ID NO: 2338 - DNA, 20 bp, Artificial Sequence
  Description of Artificial Sequence: Synthetic oligonucleotide
agttcacaaatcatctgctg

SEQ ID NO: 2339 - DNA, 20 bp, Artificial Sequence
  Description of Artificial Sequence: Synthetic oligonucleotide
tgactcgtctgtttcgtacc

SEQ ID NO: 2340 - DNA, 20 bp, Artificial Sequence
  Description of Artificial Sequence: Synthetic oligonucleotide
ttggaagtaggatgggaccg

SEQ ID NO: 2341 - DNA, 21 bp, Artificial Sequence
  Description of Artificial Sequence: Synthetic oligonucleotide
tttgaagggtgatgggtccgc

SEQ ID NO: 2342 - DNA, 20 bp, Artificial Sequence
  Description of Artificial Sequence: Synthetic oligonucleotide
ttgggtgtagggcgctaccg

SEQ ID NO: 2343 - DNA, 18 bp, Artificial Sequence
  Description of Artificial Sequence: Synthetic oligonucleotide
ttgggtagggtggtactg

SEQ ID NO: 2344 - DNA, 21 bp, Artificial Sequence
  Description of Artificial Sequence: Synthetic oligonucleotide
tttgaagggtgatgggtccgg

SEQ ID NO: 2345 - DNA, 20 bp, Artificial Sequence
  Description of Artificial Sequence: Synthetic oligonucleotide
ttgggtgtagggaggtaccc

SEQ ID NO: 2346 - DNA, 20 bp, Artificial Sequence
  Description of Artificial Sequence: Synthetic oligonucleotide
tttgaaggttgatggttccg

SEQ ID NO: 2347 - DNA, 20 bp, Artificial Sequence
  Description of Artificial Sequence: Synthetic oligonucleotide
tttgaagggggatgggtcca

SEQ ID NO: 2348 - DNA, 20 bp, Artificial Sequence
  Description of Artificial Sequence: Synthetic oligonucleotide
tttgaagcgcgatgggtccg

SEQ ID NO: 2349 - DNA, 20 bp, Artificial Sequence
  Description of Artificial Sequence: Synthetic oligonucleotide
tttgcagggtggtgggtccg

SEQ ID NO: 2350 - DNA, 20 bp, Artificial Sequence
  Description of Artificial Sequence: Synthetic oligonucleotide
attggaggggggagggactg

SEQ ID NO: 2351 - DNA, 20 bp, Artificial Sequence
  Description of Artificial Sequence: Synthetic oligonucleotide
ttgggagggtgatgggtccg

SEQ ID NO: 2352 - DNA, 20 bp, Artificial Sequence
  Description of Artificial Sequence: Synthetic oligonucleotide
tttgcagggtgctgggtccg

SEQ ID NO: 2353 - DNA, 20 bp, Artificial Sequence
  Description of Artificial Sequence: Synthetic oligonucleotide
tttgaagggtgttgggtccc

SEQ ID NO: 2354 - DNA, 21 bp, Artificial Sequence
  Description of Artificial Sequence: Synthetic oligonucleotide
tttgggtgtagggtggtacct

SEQ ID NO: 2355 - DNA, 20 bp, Artificial Sequence
  Description of Artificial Sequence: Synthetic oligonucleotide
tgtcggaggaggaggtaccg

SEQ ID NO: 2356 - DNA, 20 bp, Artificial Sequence
  Description of Artificial Sequence: Synthetic oligonucleotide
tcatcgttgtccttggtccc

SEQ ID NO: 2357 - DNA, 20 bp, Artificial Sequence
  Description of Artificial Sequence: Synthetic oligonucleotide
ccactgcaagaatggtgctg

SEQ ID NO: 2358 - DNA, 20 bp, Artificial Sequence
  Description of Artificial Sequence: Synthetic oligonucleotide
cttgtcgtcttggtcgtccc

SEQ ID NO: 2359 - DNA, 20 bp, Artificial Sequence
  Description of Artificial Sequence: Synthetic oligonucleotide
gttgaagtgtccgtactgtg

SEQ ID NO: 2360 - DNA, 20 bp, Artificial Sequence
  Description of Artificial Sequence: Synthetic oligonucleotide
agagtttcgtcagccgtgtg

SEQ ID NO: 2361 - DNA, 20 bp, Artificial Sequence
  Description of Artificial Sequence: Synthetic oligonucleotide
gagtccgtcaatgttgtgtc

SEQ ID NO: 2362 - DNA, 20 bp, Artificial Sequence
  Description of Artificial Sequence: Synthetic oligonucleotide
accgaacacaataagtaccg

SEQ ID NO: 2363 - DNA, 20 bp, Artificial Sequence
  Description of Artificial Sequence: Synthetic oligonucleotide
gtgtgccgatttggcatggc

SEQ ID NO: 2364 - DNA, 20 bp, Artificial Sequence
  Description of Artificial Sequence: Synthetic oligonucleotide
cgaatcgtactaccgtgcac

SEQ ID NO: 2365 - DNA, 20 bp, Artificial Sequence
  Description of Artificial Sequence: Synthetic oligonucleotide
ccatcaatgtaaggggtgac

SEQ ID NO: 2366 - DNA, 20 bp, Artificial Sequence
  Description of Artificial Sequence: Synthetic oligonucleotide
aacgagaagtctactccccc

SEQ ID NO: 2367 - DNA, 20 bp, Artificial Sequence
  Description of Artificial Sequence: Synthetic oligonucleotide
tgtcgtagtggcgttgtggc

SEQ ID NO: 2368 - DNA, 20 bp, Artificial Sequence
  Description of Artificial Sequence: Synthetic oligonucleotide
agtcgtggttcccgcgtcat

SEQ ID NO: 2369 - DNA, 20 bp, Artificial Sequence
  Description of Artificial Sequence: Synthetic oligonucleotide
accagccagtacagcgctgc

SEQ ID NO: 2370 - DNA, 20 bp, Artificial Sequence
  Description of Artificial Sequence: Synthetic oligonucleotide
tttgaagggtggtggctccg

SEQ ID NO: 2371 - DNA, 20 bp, Artificial Sequence
  Description of Artificial Sequence: Synthetic oligonucleotide
tcggtacagttgctctgctg

SEQ ID NO: 2372 - DNA, 20 bp, Artificial Sequence
  Description of Artificial Sequence: Synthetic oligonucleotide
tctccgatgcatgtagccgt

SEQ ID NO: 2373 - DNA, 19 bp, Artificial Sequence
  Description of Artificial Sequence: Synthetic oligonucleotide
atgtatgtgggagccacgc

SEQ ID NO: 2374 - DNA, 20 bp, Artificial Sequence
  Description of Artificial Sequence: Synthetic oligonucleotide
agctgtaattcatgtctgtg

SEQ ID NO: 2375 - DNA, 20 bp, Artificial Sequence
  Description of Artificial Sequence: Synthetic oligonucleotide
ttcttctcccaacgtgtgta

SEQ ID NO: 2376 - DNA, 20 bp, Artificial Sequence
  Description of Artificial Sequence: Synthetic oligonucleotide
aaccccttcctcgtctcgtc

SEQ ID NO: 2377 - DNA, 20 bp, Artificial Sequence
  Description of Artificial Sequence: Synthetic oligonucleotide
cttcaacacctcttcgtctg

SEQ ID NO: 2378 - DNA, 20 bp, Artificial Sequence
  Description of Artificial Sequence: Synthetic oligonucleotide
catacgtctaacccgtgccc

SEQ ID NO: 2379 - DNA, 20 bp, Artificial Sequence
  Description of Artificial Sequence: Synthetic oligonucleotide
cactaaggttgaccggtatc

SEQ ID NO: 2380 - DNA, 20 bp, Artificial Sequence
  Description of Artificial Sequence: Synthetic oligonucleotide
atttctacctatagcttctg

SEQ ID NO: 2381 - DNA, 20 bp, Artificial Sequence
  Description of Artificial Sequence: Synthetic oligonucleotide
tctgaagggtgatgggtccc

SEQ ID NO: 2382 - DNA, 20 bp, Artificial Sequence
  Description of Artificial Sequence: Synthetic oligonucleotide
cttggcgtcttgttcgtccc

SEQ ID NO: 2383 - DNA, 20 bp, Artificial Sequence
  Description of Artificial Sequence: Synthetic oligonucleotide
atagggagaagtgtgaaccg

SEQ ID NO: 2384 - DNA, 20 bp, Artificial Sequence
  Description of Artificial Sequence: Synthetic oligonucleotide
taatctgtccaacgcgtgcc

SEQ ID NO: 2385 - DNA, 20 bp, Artificial Sequence
  Description of Artificial Sequence: Synthetic oligonucleotide
atccggcattcctccgtgtg

SEQ ID NO: 2386 - DNA, 20 bp, Artificial Sequence
  Description of Artificial Sequence: Synthetic oligonucleotide
attggtgaggggagggaccg

SEQ ID NO: 2387 - DNA, 20 bp, Artificial Sequence
  Description of Artificial Sequence: Synthetic oligonucleotide
ccaatgaatcctgtaccgca

SEQ ID NO: 2388 - DNA, 20 bp, Artificial Sequence
  Description of Artificial Sequence: Synthetic oligonucleotide
ttgggtgtagggtggaactg

SEQ ID NO: 2389 - DNA, 20 bp, Artificial Sequence
  Description of Artificial Sequence: Synthetic oligonucleotide
tttctcccacgctgtgttgc

SEQ ID NO: 2390 - DNA, 20 bp, Artificial Sequence
  Description of Artificial Sequence: Synthetic oligonucleotide
ggttctactggtcaccgtgc

SEQ ID NO: 2391 - DNA, 20 bp, Artificial Sequence
  Description of Artificial Sequence: Synthetic oligonucleotide
acttttgcgatatgtagccg

SEQ ID NO: 2392 - DNA, 20 bp, Artificial Sequence
  Description of Artificial Sequence: Synthetic oligonucleotide
atcgggtagccgtccagtgc

SEQ ID NO: 2393 - DNA, 20 bp, Artificial Sequence
  Description of Artificial Sequence: Synthetic oligonucleotide
tcgcattcgattgttccccc

SEQ ID NO: 2394 - DNA, 20 bp, Artificial Sequence
  Description of Artificial Sequence: Synthetic oligonucleotide
tctagtcttggatggtgcgc

SEQ ID NO: 2395 - DNA, 20 bp, Artificial Sequence
  Description of Artificial Sequence: Synthetic oligonucleotide
gttgaacgggcaacctaccc

SEQ ID NO: 2396 - DNA, 20 bp, Artificial Sequence
  Description of Artificial Sequence: Synthetic oligonucleotide
atcgcatgtctgtcgctgcc

SEQ ID NO: 2397 - DNA, 20 bp, Artificial Sequence
  Description of Artificial Sequence: Synthetic oligonucleotide
attaatgaagggaggtactg

SEQ ID NO: 2398 - DNA, 20 bp, Artificial Sequence
  Description of Artificial Sequence: Synthetic oligonucleotide
tgagaactccacgtgcgctc

SEQ ID NO: 2399 - DNA, 20 bp, Artificial Sequence
  Description of Artificial Sequence: Synthetic oligonucleotide
atgtccccatcttcgtcccc

SEQ ID NO: 2400 - DNA, 20 bp, Artificial Sequence
  Description of Artificial Sequence: Synthetic oligonucleotide
cattgtgctcgttttgcccc

SEQ ID NO: 2401 - DNA, 20 bp, Artificial Sequence
  Description of Artificial Sequence: Synthetic oligonucleotide
atcgtgtggctgtgtgtggc

SEQ ID NO: 2402 - DNA, 20 bp, Artificial Sequence
  Description of Artificial Sequence: Synthetic oligonucleotide
tatcactcaaagtctgccgc

SEQ ID NO: 2403 - DNA, 20 bp, Artificial Sequence
  Description of Artificial Sequence: Synthetic oligonucleotide
tgcatgctagaacatgtgtg

SEQ ID NO: 2404 - DNA, 20 bp, Artificial Sequence
  Description of Artificial Sequence: Synthetic oligonucleotide
ttgtcctgcataactgtgcc

SEQ ID NO: 2405 - DNA, 20 bp, Artificial Sequence
  Description of Artificial Sequence: Synthetic oligonucleotide
ctccccatgagtgtcttgtg

SEQ ID NO: 2406 - DNA, 20 bp, Artificial Sequence
  Description of Artificial Sequence: Synthetic oligonucleotide
acgagagccatctgtaggtg

SEQ ID NO: 2407 - DNA, 20 bp, Artificial Sequence
  Description of Artificial Sequence: Synthetic oligonucleotide
gtatgtaatctgccgttctg

SEQ ID NO: 2408 - DNA, 20 bp, Artificial Sequence
  Description of Artificial Sequence: Synthetic oligonucleotide
gacgacgagtttgccgcatg

SEQ ID NO: 2409 - DNA, 20 bp, Artificial Sequence
  Description of Artificial Sequence: Synthetic oligonucleotide
cttggtgtagggtggtaccg

SEQ ID NO: 2410 - DNA, 20 bp, Artificial Sequence
  Description of Artificial Sequence: Synthetic oligonucleotide
tgtaggaggaggaggtcccg

SEQ ID NO: 2411 - DNA, 20 bp, Artificial Sequence
  Description of Artificial Sequence: Synthetic oligonucleotide
atcgtcgagtgatctgcccg

SEQ ID NO: 2412 - DNA, 20 bp, Artificial Sequence
  Description of Artificial Sequence: Synthetic oligonucleotide
ctgcacaaaataggctgcac

SEQ ID NO: 2413 - DNA, 20 bp, Artificial Sequence
  Description of Artificial Sequence: Synthetic oligonucleotide
attgctgggatttttggccg

SEQ ID NO: 2414 - DNA, 20 bp, Artificial Sequence
  Description of Artificial Sequence: Synthetic oligonucleotide
tgtctagtaattggtgtctg

SEQ ID NO: 2415 - DNA, 20 bp, Artificial Sequence
  Description of Artificial Sequence: Synthetic oligonucleotide
aaactccgtcttccacgcgc

SEQ ID NO: 2416 - DNA, 20 bp, Artificial Sequence
  Description of Artificial Sequence: Synthetic oligonucleotide
aagtgtcctcttactggtgc

SEQ ID NO: 2417 - DNA, 20 bp, Artificial Sequence
  Description of Artificial Sequence: Synthetic oligonucleotide
tcccccaatgtcgctgtggc

SEQ ID NO: 2418 - DNA, 20 bp, Artificial Sequence
  Description of Artificial Sequence: Synthetic oligonucleotide
gttgaagagtgatgggtccg

SEQ ID NO: 2419 - DNA, 20 bp, Artificial Sequence
  Description of Artificial Sequence: Synthetic oligonucleotide
tttcgctattcctgactcgc

SEQ ID NO: 2420 - DNA, 20 bp, Artificial Sequence
  Description of Artificial Sequence: Synthetic oligonucleotide
cgagcatctgtcaacggtac

SEQ ID NO: 2421 - DNA, 20 bp, Artificial Sequence
  Description of Artificial Sequence: Synthetic oligonucleotide
atcatcatcctttgcgtggc

SEQ ID NO: 2422 - DNA, 20 bp, Artificial Sequence
  Description of Artificial Sequence: Synthetic oligonucleotide
tgactccactgtactgtccc

SEQ ID NO: 2423 - DNA, 20 bp, Artificial Sequence
  Description of Artificial Sequence: Synthetic oligonucleotide
caacgtccaaaatgtaggtc

SEQ ID NO: 2424 - DNA, 20 bp, Artificial Sequence
  Description of Artificial Sequence: Synthetic oligonucleotide
gacgagcataccacggtccc

SEQ ID NO: 2425 - DNA, 20 bp, Artificial Sequence
  Description of Artificial Sequence: Synthetic oligonucleotide
ttctccacacgactcgtctg

SEQ ID NO: 2426 - DNA, 20 bp, Artificial Sequence
  Description of Artificial Sequence: Synthetic oligonucleotide
caatcgtctgttgttggtgc

SEQ ID NO: 2427 - DNA, 20 bp, Artificial Sequence
  Description of Artificial Sequence: Synthetic oligonucleotide
aatacggacgaatcctcgta

SEQ ID NO: 2428 - DNA, 20 bp, Artificial Sequence
  Description of Artificial Sequence: Synthetic oligonucleotide
agtctgtctgtacaatgctg

SEQ ID NO: 2429 - DNA, 20 bp, Artificial Sequence
  Description of Artificial Sequence: Synthetic oligonucleotide
ctatcagtcaacgtggtgcc

SEQ ID NO: 2430 - DNA, 20 bp, Artificial Sequence
  Description of Artificial Sequence: Synthetic oligonucleotide
aagatgatcgtcacagtatg

SEQ ID NO: 2431 - DNA, 20 bp, Artificial Sequence
  Description of Artificial Sequence: Synthetic oligonucleotide
gttcggtctgattcctcccc

SEQ ID NO: 2432 - DNA, 20 bp, Artificial Sequence
  Description of Artificial Sequence: Synthetic oligonucleotide
tatctacttattgaagtgcc

SEQ ID NO: 2433 - DNA, 20 bp, Artificial Sequence
  Description of Artificial Sequence: Synthetic oligonucleotide
tgtcttggaaaactggtccg

SEQ ID NO: 2434 - DNA, 20 bp, Artificial Sequence
  Description of Artificial Sequence: Synthetic oligonucleotide
acaagctgtaacaccgcgtg

SEQ ID NO: 2435 - DNA, 20 bp, Artificial Sequence
  Description of Artificial Sequence: Synthetic oligonucleotide
cagtcatccatctggtcgta

SEQ ID NO: 2436 - DNA, 20 bp, Artificial Sequence
  Description of Artificial Sequence: Synthetic oligonucleotide
attgtctgtggtgctagccc

SEQ ID NO: 2437 - DNA, 20 bp, Artificial Sequence
  Description of Artificial Sequence: Synthetic oligonucleotide
ctgtgaggagcagggtggtg

SEQ ID NO: 2438 - DNA, 20 bp, Artificial Sequence
  Description of Artificial Sequence: Synthetic oligonucleotide
tattggaggtgtagggacag

SEQ ID NO: 2439 - DNA, 20 bp, Artificial Sequence
  Description of Artificial Sequence: Synthetic oligonucleotide
gagattgtacgggtgtgccc

SEQ ID NO: 2440 - DNA, 20 bp, Artificial Sequence
  Description of Artificial Sequence: Synthetic oligonucleotide
atcgtgatggatgccgtgcc

SEQ ID NO: 2441 - DNA, 20 bp, Artificial Sequence
  Description of Artificial Sequence: Synthetic oligonucleotide
tctgaagggggatgggtccg

SEQ ID NO: 2442 - DNA, 20 bp, Artificial Sequence
  Description of Artificial Sequence: Synthetic oligonucleotide
ttgggtgtcgggcggtaccg

SEQ ID NO: 2443 - DNA, 20 bp, Artificial Sequence
  Description of Artificial Sequence: Synthetic oligonucleotide
tttcgttcctctgtgcgctg

SEQ ID NO: 2444 - DNA, 20 bp, Artificial Sequence
  Description of Artificial Sequence: Synthetic oligonucleotide
ttttaagggttatgggtccg

SEQ ID NO: 2445 - DNA, 20 bp, Artificial Sequence
  Description of Artificial Sequence: Synthetic oligonucleotide
ttgggtgtaggtgggtaccg

SEQ ID NO: 2446 - DNA, 20 bp, Artificial Sequence
  Description of Artificial Sequence: Synthetic oligonucleotide
tttgaagtagggtggtaccg

SEQ ID NO: 2447 - DNA, 20 bp, Artificial Sequence
  Description of Artificial Sequence: Synthetic oligonucleotide
tattggaggtgtagggatcg

SEQ ID NO: 2448 - DNA, 20 bp, Artificial Sequence
  Description of Artificial Sequence: Synthetic oligonucleotide
ttgggagaagggtggtaccg

SEQ ID NO: 2449 - DNA, 20 bp, Artificial Sequence
  Description of Artificial Sequence: Synthetic oligonucleotide
ccgtttaaccgtcctgtccc

SEQ ID NO: 2450 - DNA, 20 bp, Artificial Sequence
  Description of Artificial Sequence: Synthetic oligonucleotide
attggagggtgatgggtccg

SEQ ID NO: 2451 - DNA, 20 bp, Artificial Sequence
  Description of Artificial Sequence: Synthetic oligonucleotide
ttagtcgttgtttgcctgtg

SEQ ID NO: 2452 - DNA, 20 bp, Artificial Sequence
  Description of Artificial Sequence: Synthetic oligonucleotide
tttgttctcctttggctcac

SEQ ID NO: 2453 - DNA, 20 bp, Artificial Sequence
  Description of Artificial Sequence: Synthetic oligonucleotide
tgactcgtctgtttcatccc

SEQ ID NO: 2454 - DNA, 20 bp, Artificial Sequence
  Description of Artificial Sequence: Synthetic oligonucleotide
tggctcgatgtcctgtaccc

SEQ ID NO: 2455 - DNA, 20 bp, Artificial Sequence
  Description of Artificial Sequence: Synthetic oligonucleotide
atcgtttggctgttgtgcac

SEQ ID NO: 2456 - DNA, 20 bp, Artificial Sequence
  Description of Artificial Sequence: Synthetic oligonucleotide
tccttgtcgtcttgtgtccc

SEQ ID NO: 2457 - DNA, 20 bp, Artificial Sequence
  Description of Artificial Sequence: Synthetic oligonucleotide
tctggcgaacatagactgcc

SEQ ID NO: 2458 - DNA, 20 bp, Artificial Sequence
  Description of Artificial Sequence: Synthetic oligonucleotide
catagtagacttgacctccc

SEQ ID NO: 2459 - DNA, 20 bp, Artificial Sequence
  Description of Artificial Sequence: Synthetic oligonucleotide
cagttgtcttcactcccccc

SEQ ID NO: 2460 - DNA, 20 bp, Artificial Sequence
  Description of Artificial Sequence: Synthetic oligonucleotide
caagtgaacgtctgagcccc

SEQ ID NO: 2461 - DNA, 20 bp, Artificial Sequence
  Description of Artificial Sequence: Synthetic oligonucleotide
accgcacgtctttatgtcgt

SEQ ID NO: 2462 - DNA, 20 bp, Artificial Sequence
  Description of Artificial Sequence: Synthetic oligonucleotide
atattgtaggtctgcatgtg

SEQ ID NO: 2463 - DNA, 20 bp, Artificial Sequence
  Description of Artificial Sequence: Synthetic oligonucleotide
tgttcgcgtgtgcttttgcc

SEQ ID NO: 2464 - DNA, 20 bp, Artificial Sequence
  Description of Artificial Sequence: Synthetic oligonucleotide
agatgccgcccttccgtgtg

SEQ ID NO: 2465 - DNA, 20 bp, Artificial Sequence
  Description of Artificial Sequence: Synthetic oligonucleotide
tgcttggacttatgtcggta

SEQ ID NO: 2466 - DNA, 20 bp, Artificial Sequence
  Description of Artificial Sequence: Synthetic oligonucleotide
taacattcctatgcgctctg

SEQ ID NO: 2467 - DNA, 20 bp, Artificial Sequence
  Description of Artificial Sequence: Synthetic oligonucleotide
tgaacgtaaaagttcatgtg

SEQ ID NO: 2468 - DNA, 20 bp, Artificial Sequence
  Description of Artificial Sequence: Synthetic oligonucleotide
ttgtctagtttgggtgctac

SEQ ID NO: 2469 - DNA, 20 bp, Artificial Sequence
  Description of Artificial Sequence: Synthetic oligonucleotide
atgcccgacgatgtcccgta

SEQ ID NO: 2470 - DNA, 20 bp, Artificial Sequence
  Description of Artificial Sequence: Synthetic oligonucleotide
gaccgtgtcaggattgccct

SEQ ID NO: 2471 - DNA, 20 bp, Artificial Sequence
  Description of Artificial Sequence: Synthetic oligonucleotide
tttgaagggtaatgggtccc

SEQ ID NO: 2472 - DNA, 20 bp, Artificial Sequence
  Description of Artificial Sequence: Synthetic oligonucleotide
taagtagtctgtatgcggtc

SEQ ID NO: 2473 - DNA, 20 bp, Artificial Sequence
  Description of Artificial Sequence: Synthetic oligonucleotide
tctcccacaaagtttggctg

SEQ ID NO: 2474 - DNA, 20 bp, Artificial Sequence
  Description of Artificial Sequence: Synthetic oligonucleotide
cacgtcttaatttccccccc

SEQ ID NO: 2475 - DNA, 20 bp, Artificial Sequence
  Description of Artificial Sequence: Synthetic oligonucleotide
taacatacgtctggccgctg

SEQ ID NO: 2476 - DNA, 20 bp, Artificial Sequence
  Description of Artificial Sequence: Synthetic oligonucleotide
tttgaagggtgatgggtggg

SEQ ID NO: 2477 - DNA, 20 bp, Artificial Sequence
  Description of Artificial Sequence: Synthetic oligonucleotide
tccccttcgttttgctgccg

SEQ ID NO: 2478 - DNA, 20 bp, Artificial Sequence
  Description of Artificial Sequence: Synthetic oligonucleotide
atcaggtgctctgtcgtgta

SEQ ID NO: 2479 - DNA, 20 bp, Artificial Sequence
  Description of Artificial Sequence: Synthetic oligonucleotide
ccgcttctcgtgttacccgc

SEQ ID NO: 2480 - DNA, 20 bp, Artificial Sequence
  Description of Artificial Sequence: Synthetic oligonucleotide
catcgactgtagtttatgtg

SEQ ID NO: 2481 - DNA, 20 bp, Artificial Sequence
  Description of Artificial Sequence: Synthetic oligonucleotide
agtgtcggatctggtgttgc

SEQ ID NO: 2482 - DNA, 20 bp, Artificial Sequence
  Description of Artificial Sequence: Synthetic oligonucleotide
cgattgttggggatctgccc

SEQ ID NO: 2483 - DNA, 20 bp, Artificial Sequence
  Description of Artificial Sequence: Synthetic oligonucleotide
aatcgctcccaattgcgtgc

SEQ ID NO: 2484 - DNA, 19 bp, Artificial Sequence
  Description of Artificial Sequence: Synthetic oligonucleotide
tatcatacgaatacgtgtg

SEQ ID NO: 2485 - DNA, 20 bp, Artificial Sequence
  Description of Artificial Sequence: Synthetic oligonucleotide
cagtaaggtcggtgcgtgtc

SEQ ID NO: 2486 - DNA, 20 bp, Artificial Sequence
  Description of Artificial Sequence: Synthetic oligonucleotide
atcctcgtaattgccgcgta

SEQ ID NO: 2487 - DNA, 20 bp, Artificial Sequence
  Description of Artificial Sequence: Synthetic oligonucleotide
tttggtgaaggggggtactg

SEQ ID NO: 2488 - DNA, 19 bp, Artificial Sequence
  Description of Artificial Sequence: Synthetic oligonucleotide
tccttgtcgtttgcgtccc

SEQ ID NO: 2489 - DNA, 20 bp, Artificial Sequence
  Description of Artificial Sequence: Synthetic oligonucleotide
agagtctgatgtcacctgtg

SEQ ID NO: 2490 - DNA, 20 bp, Artificial Sequence
  Description of Artificial Sequence: Synthetic oligonucleotide
gcggtacgatctaatctccc

SEQ ID NO: 2491 - DNA, 20 bp, Artificial Sequence
  Description of Artificial Sequence: Synthetic oligonucleotide
gcagcgctagttctcgtgac

SEQ ID NO: 2492 - DNA, 20 bp, Artificial Sequence
  Description of Artificial Sequence: Synthetic oligonucleotide
aatgagtctgaccgtcacgc

SEQ ID NO: 2493 - DNA, 20 bp, Artificial Sequence
  Description of Artificial Sequence: Synthetic oligonucleotide
gttgaggggtgatgggtccg

SEQ ID NO: 2494 - DNA, 18 bp, Artificial Sequence
  Description of Artificial Sequence: Synthetic oligonucleotide
gcctttcgttcccctccc

SEQ ID NO: 2495 - DNA, 20 bp, Artificial Sequence
  Description of Artificial Sequence: Synthetic oligonucleotide
tttgaagggttatgggcccg

SEQ ID NO: 2496 - DNA, 20 bp, Artificial Sequence
  Description of Artificial Sequence: Synthetic oligonucleotide
gttggtggagggaggtactg

SEQ ID NO: 2497 - DNA, 20 bp, Artificial Sequence
  Description of Artificial Sequence: Synthetic oligonucleotide
aatgaattatctacattccc

SEQ ID NO: 2498 - DNA, 20 bp, Artificial Sequence
  Description of Artificial Sequence: Synthetic oligonucleotide
tcatgcgatagtctcccccc

SEQ ID NO: 2499 - DNA, 20 bp, Artificial Sequence
  Description of Artificial Sequence: Synthetic oligonucleotide
ttcttcccttgttgcgggta

SEQ ID NO: 2500 - DNA, 19 bp, Artificial Sequence
  Description of Artificial Sequence: Synthetic oligonucleotide
cccgtcgtctgttcgtccc

SEQ ID NO: 2501 - DNA, 20 bp, Artificial Sequence
  Description of Artificial Sequence: Synthetic oligonucleotide
aaccctgtgcacatgccgta

SEQ ID NO: 2502 - DNA, 20 bp, Artificial Sequence
  Description of Artificial Sequence: Synthetic oligonucleotide
atatacgtacatgggtggcc

SEQ ID NO: 2503 - DNA, 20 bp, Artificial Sequence
  Description of Artificial Sequence: Synthetic oligonucleotide
gtcctgtgcgcctgtgtgac

SEQ ID NO: 2504 - DNA, 20 bp, Artificial Sequence
  Description of Artificial Sequence: Synthetic oligonucleotide
taggtgcaaatccacagccc

SEQ ID NO: 2505 - DNA, 20 bp, Artificial Sequence
  Description of Artificial Sequence: Synthetic oligonucleotide
aatcttgacccctcgccatg

SEQ ID NO: 2506 - DNA, 20 bp, Artificial Sequence
  Description of Artificial Sequence: Synthetic oligonucleotide
accgtatcatcatgccgcca

SEQ ID NO: 2507 - DNA, 20 bp, Artificial Sequence
  Description of Artificial Sequence: Synthetic oligonucleotide
attggaggagggaggtactg

SEQ ID NO: 2508 - DNA, 19 bp, Artificial Sequence
  Description of Artificial Sequence: Synthetic oligonucleotide
tctgtgtgggatgttgccc

SEQ ID NO: 2509 - DNA, 20 bp, Artificial Sequence
  Description of Artificial Sequence: Synthetic oligonucleotide
cctatcgtcatgttcgtggc

SEQ ID NO: 2510 - DNA, 20 bp, Artificial Sequence
  Description of Artificial Sequence: Synthetic oligonucleotide
cataggacagggttgtggcc

SEQ ID NO: 2511 - DNA, 20 bp, Artificial Sequence
  Description of Artificial Sequence: Synthetic oligonucleotide
ccttcattgtcttcgcggta

SEQ ID NO: 2512 - DNA, 20 bp, Artificial Sequence
  Description of Artificial Sequence: Synthetic oligonucleotide
gctatgtgtgttcgttgggc

SEQ ID NO: 2513 - DNA, 20 bp, Artificial Sequence
  Description of Artificial Sequence: Synthetic oligonucleotide
tcctgttgccccatgtgtgc

SEQ ID NO: 2514 - DNA, 20 bp, Artificial Sequence
  Description of Artificial Sequence: Synthetic oligonucleotide
accagcgtatgtacactccc

SEQ ID NO: 2515 - DNA, 20 bp, Artificial Sequence
  Description of Artificial Sequence: Synthetic oligonucleotide
tgtaggaggtgtagggaccg

SEQ ID NO: 2516 - DNA, 20 bp, Artificial Sequence
  Description of Artificial Sequence: Synthetic oligonucleotide
gttgatgctggtcacgatgc

SEQ ID NO: 2517 - DNA, 20 bp, Artificial Sequence
  Description of Artificial Sequence: Synthetic oligonucleotide
tgtccgttcccgatctgtgc

SEQ ID NO: 2518 - DNA, 20 bp, Artificial Sequence
  Description of Artificial Sequence: Synthetic oligonucleotide
agtgtgagtcgttgtacccc

SEQ ID NO: 2519 - DNA, 20 bp, Artificial Sequence
  Description of Artificial Sequence: Synthetic oligonucleotide
agtagcgcctgctgactgcc

SEQ ID NO: 2520 - DNA, 20 bp, Artificial Sequence
  Description of Artificial Sequence: Synthetic oligonucleotide
gtgagcatctgacccctgtc

SEQ ID NO: 2521 - DNA, 20 bp, Artificial Sequence
  Description of Artificial Sequence: Synthetic oligonucleotide
tataatcctgtgcctgaccc

SEQ ID NO: 2522 - DNA, 20 bp, Artificial Sequence
  Description of Artificial Sequence: Synthetic oligonucleotide
ggaacctcacagtatgtccg

SEQ ID NO: 2523 - DNA, 20 bp, Artificial Sequence
  Description of Artificial Sequence: Synthetic oligonucleotide
gttcacgattagcgcctggc

SEQ ID NO: 2524 - DNA, 20 bp, Artificial Sequence
  Description of Artificial Sequence: Synthetic oligonucleotide
cgtattgtctcgccagtgtg

SEQ ID NO: 2525 - DNA, 20 bp, Artificial Sequence
  Description of Artificial Sequence: Synthetic oligonucleotide
gtgtcttctgagttttggcc

SEQ ID NO: 2526 - DNA, 20 bp, Artificial Sequence
  Description of Artificial Sequence: Synthetic oligonucleotide
tttgaagggggatgggttcg

SEQ ID NO: 2527 - DNA, 20 bp, Artificial Sequence
  Description of Artificial Sequence: Synthetic oligonucleotide
tttgaagattgatgggtccg

SEQ ID NO: 2528 - DNA, 20 bp, Artificial Sequence
  Description of Artificial Sequence: Synthetic oligonucleotide
tttgaaggcagatgggtccg

SEQ ID NO: 2529 - DNA, 20 bp, Artificial Sequence
  Description of Artificial Sequence: Synthetic oligonucleotide
tttgaagggcgatgggtacg

SEQ ID NO: 2530 - DNA, 20 bp, Artificial Sequence
  Description of Artificial Sequence: Synthetic oligonucleotide
tttgtggggtgatgggtccg

SEQ ID NO: 2531 - DNA, 20 bp, Artificial Sequence
  Description of Artificial Sequence: Synthetic oligonucleotide
ttgggtgtaggggggtaccc

SEQ ID NO: 2532 - DNA, 20 bp, Artificial Sequence
  Description of Artificial Sequence: Synthetic oligonucleotide
attggtggagggtggtactg

SEQ ID NO: 2533 - DNA, 20 bp, Artificial Sequence
  Description of Artificial Sequence: Synthetic oligonucleotide
attggtgcagggaggcactg

SEQ ID NO: 2534 - DNA, 20 bp, Artificial Sequence
  Description of Artificial Sequence: Synthetic oligonucleotide
tttgaagggtgatggggcgg

SEQ ID NO: 2535 - DNA, 20 bp, Artificial Sequence
  Description of Artificial Sequence: Synthetic oligonucleotide
gtgggtgtaggggggtaccg

SEQ ID NO: 2536 - DNA, 20 bp, Artificial Sequence
  Description of Artificial Sequence: Synthetic oligonucleotide
tttgaaggttgatgggtccc

SEQ ID NO: 2537 - DNA, 20 bp, Artificial Sequence
  Description of Artificial Sequence: Synthetic oligonucleotide
tttgaagggtggtgggttcg

SEQ ID NO: 2538 - DNA, 20 bp, Artificial Sequence
  Description of Artificial Sequence: Synthetic oligonucleotide
ttgggtgtagaatggtaccg

SEQ ID NO: 2539 - DNA, 20 bp, Artificial Sequence
  Description of Artificial Sequence: Synthetic oligonucleotide
tttgaacggagatgggtccg

SEQ ID NO: 2540 - DNA, 20 bp, Artificial Sequence
  Description of Artificial Sequence: Synthetic oligonucleotide
atcgaaggatttttgggctg

SEQ ID NO: 2541 - DNA, 21 bp, Artificial Sequence
  Description of Artificial Sequence: Synthetic oligonucleotide
tttgaagggtgatgatgtccg

SEQ ID NO: 2542 - DNA, 20 bp, Artificial Sequence
  Description of Artificial Sequence: Synthetic oligonucleotide
tatttgaggtgtagggaccg

SEQ ID NO: 2543 - DNA, 20 bp, Artificial Sequence
  Description of Artificial Sequence: Synthetic oligonucleotide
tgtagggaggtagctatcgt

SEQ ID NO: 2544 - DNA, 20 bp, Artificial Sequence
  Description of Artificial Sequence: Synthetic oligonucleotide
ttgggtgtagggctgtaccg

SEQ ID NO: 2545 - DNA, 20 bp, Artificial Sequence
  Description of Artificial Sequence: Synthetic oligonucleotide
tagccttcattgttgccccc

SEQ ID NO: 2546 - DNA, 20 bp, Artificial Sequence
  Description of Artificial Sequence: Synthetic oligonucleotide
acagggagaagggtgaaccg

SEQ ID NO: 2547 - DNA, 20 bp, Artificial Sequence
  Description of Artificial Sequence: Synthetic oligonucleotide
tttgaatggtgatgggtctg

SEQ ID NO: 2548 - DNA, 20 bp, Artificial Sequence
  Description of Artificial Sequence: Synthetic oligonucleotide
tcctgtcgtctttgcgttcc

SEQ ID NO: 2549 - DNA, 20 bp, Artificial Sequence
  Description of Artificial Sequence: Synthetic oligonucleotide
cggggtgtagggtggtaccg

SEQ ID NO: 2550 - DNA, 19 bp, Artificial Sequence
  Description of Artificial Sequence: Synthetic oligonucleotide
ctggtgaagggaggtactg

SEQ ID NO: 2551 - DNA, 20 bp, Artificial Sequence
  Description of Artificial Sequence: Synthetic oligonucleotide
tttgaagggtgattggtccc

SEQ ID NO: 2552 - DNA, 19 bp, Artificial Sequence
  Description of Artificial Sequence: Synthetic oligonucleotide
ttgggtgagggtggtaccg

SEQ ID NO: 2553 - DNA, 20 bp, Artificial Sequence
  Description of Artificial Sequence: Synthetic oligonucleotide
gtgacaaactaggtgggcgc

SEQ ID NO: 2554 - DNA, 20 bp, Artificial Sequence
  Description of Artificial Sequence: Synthetic oligonucleotide
ccaggtcgttctactcaccc

SEQ ID NO: 2555 - DNA, 20 bp, Artificial Sequence
  Description of Artificial Sequence: Synthetic oligonucleotide
tgccgattaagtctggttgc

SEQ ID NO: 2556 - DNA, 20 bp, Artificial Sequence
  Description of Artificial Sequence: Synthetic oligonucleotide
tcagctggaggttgccccta

SEQ ID NO: 2557 - DNA, 20 bp, Artificial Sequence
  Description of Artificial Sequence: Synthetic oligonucleotide
gaggtaatgtctgggtgctc

SEQ ID NO: 2558 - DNA, 20 bp, Artificial Sequence
  Description of Artificial Sequence: Synthetic oligonucleotide
catccgttgtgtcatgtcgg

SEQ ID NO: 2559 - DNA, 20 bp, Artificial Sequence
  Description of Artificial Sequence: Synthetic oligonucleotide
atcacttcgcaccttgtccc

SEQ ID NO: 2560 - DNA, 20 bp, Artificial Sequence
  Description of Artificial Sequence: Synthetic oligonucleotide
agttagcatcatctcgtccg

SEQ ID NO: 2561 - DNA, 20 bp, Artificial Sequence
  Description of Artificial Sequence: Synthetic oligonucleotide
tgagatgtctgtttgccggc

SEQ ID NO: 2562 - DNA, 20 bp, Artificial Sequence
  Description of Artificial Sequence: Synthetic oligonucleotide
gatccggaatccgtcgtgta

SEQ ID NO: 2563 - DNA, 20 bp, Artificial Sequence
  Description of Artificial Sequence: Synthetic oligonucleotide
tcccgttctctctcgtacgc

SEQ ID NO: 2564 - DNA, 20 bp, Artificial Sequence
  Description of Artificial Sequence: Synthetic oligonucleotide
taccgcgttcatatcccggc

SEQ ID NO: 2565 - DNA, 20 bp, Artificial Sequence
  Description of Artificial Sequence: Synthetic oligonucleotide
tcggtgtccacagttgtgta

SEQ ID NO: 2566 - DNA, 20 bp, Artificial Sequence
  Description of Artificial Sequence: Synthetic oligonucleotide
tgtggtgagtaggcactgac

SEQ ID NO: 2567 - DNA, 20 bp, Artificial Sequence
  Description of Artificial Sequence: Synthetic oligonucleotide
tttgtgcaatattcgtcgtg

SEQ ID NO: 2568 - DNA, 20 bp, Artificial Sequence
  Description of Artificial Sequence: Synthetic oligonucleotide
tgagatctgacgacatgcgc

SEQ ID NO: 2569 - DNA, 20 bp, Artificial Sequence
  Description of Artificial Sequence: Synthetic oligonucleotide
acgatgtactggtttgccgc

SEQ ID NO: 2570 - DNA, 20 bp, Artificial Sequence
  Description of Artificial Sequence: Synthetic oligonucleotide
attgcgtaaccagcgttgta

SEQ ID NO: 2571 - DNA, 20 bp, Artificial Sequence
  Description of Artificial Sequence: Synthetic oligonucleotide
caattcgtcttacgccaccc

SEQ ID NO: 2572 - DNA, 20 bp, Artificial Sequence
  Description of Artificial Sequence: Synthetic oligonucleotide
tcagagtacttgagagcccc

SEQ ID NO: 2573 - DNA, 20 bp, Artificial Sequence
  Description of Artificial Sequence: Synthetic oligonucleotide
tgagtaagcctgtgtttgtc

SEQ ID NO: 2574 - DNA, 20 bp, Artificial Sequence
  Description of Artificial Sequence: Synthetic oligonucleotide
gtcgccaatacttacggccg

SEQ ID NO: 2575 - DNA, 20 bp, Artificial Sequence
  Description of Artificial Sequence: Synthetic oligonucleotide
gtttggtactggtttcccac

SEQ ID NO: 2576 - DNA, 20 bp, Artificial Sequence
  Description of Artificial Sequence: Synthetic oligonucleotide
aaacgacggtgacgttactg

SEQ ID NO: 2577 - DNA, 20 bp, Artificial Sequence
  Description of Artificial Sequence: Synthetic oligonucleotide
caccgctttcgtggtctccc

SEQ ID NO: 2578 - DNA, 20 bp, Artificial Sequence
  Description of Artificial Sequence: Synthetic oligonucleotide
catcagttttttcccgtgtg

SEQ ID NO: 2579 - DNA, 19 bp, Artificial Sequence
  Description of Artificial Sequence: Synthetic oligonucleotide
gtgtctctggttggcggac

SEQ ID NO: 2580 - DNA, 20 bp, Artificial Sequence
  Description of Artificial Sequence: Synthetic oligonucleotide
agcgaatagggtcaggtgtg

SEQ ID NO: 2581 - DNA, 20 bp, Artificial Sequence
  Description of Artificial Sequence: Synthetic oligonucleotide
tttcgtttctaacccgtgtg

SEQ ID NO: 2582 - DNA, 20 bp, Artificial Sequence
  Description of Artificial Sequence: Synthetic oligonucleotide
cagttgtaaggttagttggc

SEQ ID NO: 2583 - DNA, 20 bp, Artificial Sequence
  Description of Artificial Sequence: Synthetic oligonucleotide
ccgccataatcttcgctccc

SEQ ID NO: 2584 - DNA, 20 bp, Artificial Sequence
  Description of Artificial Sequence: Synthetic oligonucleotide
gatgacgtgctgttgcgcgc

SEQ ID NO: 2585 - DNA, 20 bp, Artificial Sequence
  Description of Artificial Sequence: Synthetic oligonucleotide
ctgtggtaatattctgtccg

SEQ ID NO: 2586 - DNA, 21 bp, Artificial Sequence
  Description of Artificial Sequence: Synthetic oligonucleotide
gcctttcgttctgcccccccc

SEQ ID NO: 2587 - DNA, 20 bp, Artificial Sequence
  Description of Artificial Sequence: Synthetic oligonucleotide
aaggtgtagaggtgttgtgc

SEQ ID NO: 2588 - DNA, 20 bp, Artificial Sequence
  Description of Artificial Sequence: Synthetic oligonucleotide
tcacctgacgtaatcagggc

SEQ ID NO: 2589 - DNA, 20 bp, Artificial Sequence
  Description of Artificial Sequence: Synthetic oligonucleotide
cgactgtacgagttcccccc

SEQ ID NO: 2590 - DNA, 20 bp, Artificial Sequence
  Description of Artificial Sequence: Synthetic oligonucleotide
gtatatgctccgcgattggc

SEQ ID NO: 2591 - DNA, 20 bp, Artificial Sequence
  Description of Artificial Sequence: Synthetic oligonucleotide
atcgactgtgctttcggggc

SEQ ID NO: 2592 - DNA, 20 bp, Artificial Sequence
  Description of Artificial Sequence: Synthetic oligonucleotide
tcccgagatttgtgagtgtc

SEQ ID NO: 2593 - DNA, 20 bp, Artificial Sequence
  Description of Artificial Sequence: Synthetic oligonucleotide
tgggtcgtctccatggtgcc

SEQ ID NO: 2594 - DNA, 20 bp, Artificial Sequence
  Description of Artificial Sequence: Synthetic oligonucleotide
acgatcgtcgtctacagctg

SEQ ID NO: 2595 - DNA, 20 bp, Artificial Sequence
  Description of Artificial Sequence: Synthetic oligonucleotide
atcttctggcttatcgtccc

SEQ ID NO: 2596 - DNA, 20 bp, Artificial Sequence
  Description of Artificial Sequence: Synthetic oligonucleotide
tcccgcttttcgttgcaccc

SEQ ID NO: 2597 - DNA, 20 bp, Artificial Sequence
  Description of Artificial Sequence: Synthetic oligonucleotide
aataacctccatactgtgtg

SEQ ID NO: 2598 - DNA, 20 bp, Artificial Sequence
  Description of Artificial Sequence: Synthetic oligonucleotide
aacgtaaacctccatacgtc

SEQ ID NO: 2599 - DNA, 20 bp, Artificial Sequence
  Description of Artificial Sequence: Synthetic oligonucleotide
gttcgtagtgtgcagggctg

SEQ ID NO: 2600 - DNA, 20 bp, Artificial Sequence
  Description of Artificial Sequence: Synthetic oligonucleotide
tgagttccttcggtctgcgc

SEQ ID NO: 2601 - DNA, 20 bp, Artificial Sequence
  Description of Artificial Sequence: Synthetic oligonucleotide
tcaggggatggcgatgatgc

SEQ ID NO: 2602 - DNA, 20 bp, Artificial Sequence
  Description of Artificial Sequence: Synthetic oligonucleotide
acgttgagtgtggcgatcgc

SEQ ID NO: 2603 - DNA, 20 bp, Artificial Sequence
  Description of Artificial Sequence: Synthetic oligonucleotide
aatgataggatacaccgctc

SEQ ID NO: 2604 - DNA, 20 bp, Artificial Sequence
  Description of Artificial Sequence: Synthetic oligonucleotide
tatgaggcgtgctagctgta

SEQ ID NO: 2605 - DNA, 20 bp, Artificial Sequence
  Description of Artificial Sequence: Synthetic oligonucleotide
tttgaagcgggatgggtccg

SEQ ID NO: 2606 - DNA, 20 bp, Artificial Sequence
  Description of Artificial Sequence: Synthetic oligonucleotide
tgcccaggatatactggcct

SEQ ID NO: 2607 - DNA, 18 bp, Artificial Sequence
  Description of Artificial Sequence: Synthetic oligonucleotide
tcatctgcgttcgccctg

SEQ ID NO: 2608 - DNA, 20 bp, Artificial Sequence
  Description of Artificial Sequence: Synthetic oligonucleotide
ctccgtactcccgaacgcca

SEQ ID NO: 2609 - DNA, 19 bp, Artificial Sequence
  Description of Artificial Sequence: Synthetic oligonucleotide
gtaggaggaggaggtaccg

SEQ ID NO: 2610 - DNA, 20 bp, Artificial Sequence
  Description of Artificial Sequence: Synthetic oligonucleotide
tttgaaggagggtgggactg

SEQ ID NO: 2611 - DNA, 20 bp, Artificial Sequence
  Description of Artificial Sequence: Synthetic oligonucleotide
atacgtgagacatatgcctg

SEQ ID NO: 2612 - DNA, 20 bp, Artificial Sequence
  Description of Artificial Sequence: Synthetic oligonucleotide
caccgtccttcgacacgtac

SEQ ID NO: 2613 - DNA, 20 bp, Artificial Sequence
  Description of Artificial Sequence: Synthetic oligonucleotide
tgctaacatctacacatctg

SEQ ID NO: 2614 - DNA, 20 bp, Artificial Sequence
  Description of Artificial Sequence: Synthetic oligonucleotide
cttcctgtcgtcttgtactg

SEQ ID NO: 2615 - DNA, 20 bp, Artificial Sequence
  Description of Artificial Sequence: Synthetic oligonucleotide
tgtcgattctggatagggcc

SEQ ID NO: 2616 - DNA, 20 bp, Artificial Sequence
  Description of Artificial Sequence: Synthetic oligonucleotide
ttggtcatttgtacacacta

SEQ ID NO: 2617 - DNA, 20 bp, Artificial Sequence
  Description of Artificial Sequence: Synthetic oligonucleotide
catttcctctggttcgtccc

SEQ ID NO: 2618 - DNA, 20 bp, Artificial Sequence
  Description of Artificial Sequence: Synthetic oligonucleotide
tgtccttcgtgtgcactccc

SEQ ID NO: 2619 - DNA, 20 bp, Artificial Sequence
  Description of Artificial Sequence: Synthetic oligonucleotide
tatacggcggggtggggata

SEQ ID NO: 2620 - DNA, 20 bp, Artificial Sequence
  Description of Artificial Sequence: Synthetic oligonucleotide
cgaagaagtgtcgtcacggc

SEQ ID NO: 2621 - DNA, 20 bp, Artificial Sequence
  Description of Artificial Sequence: Synthetic oligonucleotide
tgtgttcctagtctgtggtg

SEQ ID NO: 2622 - DNA, 20 bp, Artificial Sequence
  Description of Artificial Sequence: Synthetic oligonucleotide
ccataacaggatatcctccc

SEQ ID NO: 2623 - DNA, 20 bp, Artificial Sequence
  Description of Artificial Sequence: Synthetic oligonucleotide
taccgtttatgctccatgtg

SEQ ID NO: 2624 - DNA, 20 bp, Artificial Sequence
  Description of Artificial Sequence: Synthetic oligonucleotide
tagggtcgatgctatctgtg

SEQ ID NO: 2625 - DNA, 20 bp, Artificial Sequence
  Description of Artificial Sequence: Synthetic oligonucleotide
tctgttaacgttcacccccc

SEQ ID NO: 2626 - DNA, 20 bp, Artificial Sequence
  Description of Artificial Sequence: Synthetic oligonucleotide
tgagtcactagctgtacgcc

SEQ ID NO: 2627 - DNA, 20 bp, Artificial Sequence
  Description of Artificial Sequence: Synthetic oligonucleotide
tttgaagggtaatgggaccg

SEQ ID NO: 2628 - DNA, 20 bp, Artificial Sequence
  Description of Artificial Sequence: Synthetic oligonucleotide
atagggagaatggtgaaccg

SEQ ID NO: 2629 - DNA, 20 bp, Artificial Sequence
  Description of Artificial Sequence: Synthetic oligonucleotide
ttttgacgtcggtgtggccc

SEQ ID NO: 2630 - DNA, 20 bp, Artificial Sequence
  Description of Artificial Sequence: Synthetic oligonucleotide
tttgaagtaggatgggaccg

SEQ ID NO: 2631 - DNA, 20 bp, Artificial Sequence
  Description of Artificial Sequence: Synthetic oligonucleotide
ctacggtttgtttacgcgta

SEQ ID NO: 2632 - DNA, 20 bp, Artificial Sequence
  Description of Artificial Sequence: Synthetic oligonucleotide
ttgaatgtagggtggtaccg

SEQ ID NO: 2633 - DNA, 20 bp, Artificial Sequence
  Description of Artificial Sequence: Synthetic oligonucleotide
cgaactgtttggttgctgtc

SEQ ID NO: 2634 - DNA, 20 bp, Artificial Sequence
  Description of Artificial Sequence: Synthetic oligonucleotide
gttgcgcctgcattggtgtg

SEQ ID NO: 2635 - DNA, 20 bp, Artificial Sequence
  Description of Artificial Sequence: Synthetic oligonucleotide
tccggtcgttactgtgatgc

SEQ ID NO: 2636 - DNA, 20 bp, Artificial Sequence
  Description of Artificial Sequence: Synthetic oligonucleotide
tgaggcagaccaattgtgtg

SEQ ID NO: 2637 - DNA, 20 bp, Artificial Sequence
  Description of Artificial Sequence: Synthetic oligonucleotide
caactttgacctctgctccc

SEQ ID NO: 2638 - DNA, 20 bp, Artificial Sequence
  Description of Artificial Sequence: Synthetic oligonucleotide
acttactcctccaccgtctg

SEQ ID NO: 2639 - DNA, 20 bp, Artificial Sequence
  Description of Artificial Sequence: Synthetic oligonucleotide
ggtgtccgaactgctgtctg

SEQ ID NO: 2640 - DNA, 20 bp, Artificial Sequence
  Description of Artificial Sequence: Synthetic oligonucleotide
cgaagagtgtttgtgtactg

SEQ ID NO: 2641 - DNA, 20 bp, Artificial Sequence
  Description of Artificial Sequence: Synthetic oligonucleotide
tcgtcttactagcctccctg

SEQ ID NO: 2642 - DNA, 20 bp, Artificial Sequence
  Description of Artificial Sequence: Synthetic oligonucleotide
atcgtctttccccgttgccg

SEQ ID NO: 2643 - DNA, 20 bp, Artificial Sequence
  Description of Artificial Sequence: Synthetic oligonucleotide
gtcttctggctcatcgtccc

SEQ ID NO: 2644 - DNA, 20 bp, Artificial Sequence
  Description of Artificial Sequence: Synthetic oligonucleotide
gaggttgtttgaccgggcgc

SEQ ID NO: 2645 - DNA, 19 bp, Artificial Sequence
  Description of Artificial Sequence: Synthetic oligonucleotide
ttcacgtgtcctgcgtccc

SEQ ID NO: 2646 - DNA, 20 bp, Artificial Sequence
  Description of Artificial Sequence: Synthetic oligonucleotide
aatggactcaccgcagcccg

SEQ ID NO: 2647 - DNA, 20 bp, Artificial Sequence
  Description of Artificial Sequence: Synthetic oligonucleotide
cccacattttgaggaccctg

SEQ ID NO: 2648 - DNA, 20 bp, Artificial Sequence
  Description of Artificial Sequence: Synthetic oligonucleotide
acgtccgtgttagcatgcgc

SEQ ID NO: 2649 - DNA, 20 bp, Artificial Sequence
  Description of Artificial Sequence: Synthetic oligonucleotide
tccttgtcgccttgcgtccc

SEQ ID NO: 2650 - DNA, 20 bp, Artificial Sequence
  Description of Artificial Sequence: Synthetic oligonucleotide
aacactactcaacgctttgc

SEQ ID NO: 2651 - DNA, 20 bp, Artificial Sequence
  Description of Artificial Sequence: Synthetic oligonucleotide
caacatggtgagtcgctccc

SEQ ID NO: 2652 - DNA, 20 bp, Artificial Sequence
  Description of Artificial Sequence: Synthetic oligonucleotide
cacgttcaatcgtgcgtggc

SEQ ID NO: 2653 - DNA, 19 bp, Artificial Sequence
  Description of Artificial Sequence: Synthetic oligonucleotide
tgagcggttcgtctgtgtc

SEQ ID NO: 2654 - DNA, 20 bp, Artificial Sequence
  Description of Artificial Sequence: Synthetic oligonucleotide
tggctgacgtcgtctatgtg

SEQ ID NO: 2655 - DNA, 20 bp, Artificial Sequence
  Description of Artificial Sequence: Synthetic oligonucleotide
tcgttgcccagttctgtgcc

SEQ ID NO: 2656 - DNA, 20 bp, Artificial Sequence
  Description of Artificial Sequence: Synthetic oligonucleotide
gaaaaggcgacaatctgctg

SEQ ID NO: 2657 - DNA, 20 bp, Artificial Sequence
  Description of Artificial Sequence: Synthetic oligonucleotide
aaacggtcctgctccttccc

SEQ ID NO: 2658 - DNA, 20 bp, Artificial Sequence
  Description of Artificial Sequence: Synthetic oligonucleotide
aaaacacacgttaggcgctg

SEQ ID NO: 2659 - DNA, 20 bp, Artificial Sequence
  Description of Artificial Sequence: Synthetic oligonucleotide
tcctgcatcaagtcttgccg

SEQ ID NO: 2660 - DNA, 20 bp, Artificial Sequence
  Description of Artificial Sequence: Synthetic oligonucleotide
tgcttgggcaagaccgtgtg

SEQ ID NO: 2661 - DNA, 20 bp, Artificial Sequence
  Description of Artificial Sequence: Synthetic oligonucleotide
acaatcaaatcctgccgccc

SEQ ID NO: 2662 - DNA, 20 bp, Artificial Sequence
  Description of Artificial Sequence: Synthetic oligonucleotide
atcgtttgtccgtgtttgtg

SEQ ID NO: 2663 - DNA, 20 bp, Artificial Sequence
  Description of Artificial Sequence: Synthetic oligonucleotide
cgtttcccctggttcgtccc

SEQ ID NO: 2664 - DNA, 20 bp, Artificial Sequence
  Description of Artificial Sequence: Synthetic oligonucleotide
taatacaccgtgctgctccc

SEQ ID NO: 2665 - DNA, 20 bp, Artificial Sequence
  Description of Artificial Sequence: Synthetic oligonucleotide
ttgggtgttgggtggtactg

SEQ ID NO: 2666 - DNA, 20 bp, Artificial Sequence
  Description of Artificial Sequence: Synthetic oligonucleotide
tttgaagggtgatgattccg

SEQ ID NO: 2667 - DNA, 20 bp, Artificial Sequence
  Description of Artificial Sequence: Synthetic oligonucleotide
atccatgacagcgctgtgtg

SEQ ID NO: 2668 - DNA, 20 bp, Artificial Sequence
  Description of Artificial Sequence: Synthetic oligonucleotide
cctttgaccggtcgtctggc

SEQ ID NO: 2669 - DNA, 20 bp, Artificial Sequence
  Description of Artificial Sequence: Synthetic oligonucleotide
aatgggctcgcttgtcactg

SEQ ID NO: 2670 - DNA, 20 bp, Artificial Sequence
  Description of Artificial Sequence: Synthetic oligonucleotide
aatatgtacgtccccctggc

SEQ ID NO: 2671 - DNA, 20 bp, Artificial Sequence
  Description of Artificial Sequence: Synthetic oligonucleotide
tagtacgcagttacccggac

SEQ ID NO: 2672 - DNA, 20 bp, Artificial Sequence
  Description of Artificial Sequence: Synthetic oligonucleotide
atatcatgttttcacgtgta

SEQ ID NO: 2673 - DNA, 20 bp, Artificial Sequence
  Description of Artificial Sequence: Synthetic oligonucleotide
tgagagtaggttatccggac

SEQ ID NO: 2674 - DNA, 20 bp, Artificial Sequence
  Description of Artificial Sequence: Synthetic oligonucleotide
tttgaagagtgctgggtccg

SEQ ID NO: 2675 - DNA, 20 bp, Artificial Sequence
  Description of Artificial Sequence: Synthetic oligonucleotide
atacttgtctaccccgtgcc

SEQ ID NO: 2676 - DNA, 20 bp, Artificial Sequence
  Description of Artificial Sequence: Synthetic oligonucleotide
tttgaggggtgatgggcccg

SEQ ID NO: 2677 - DNA, 20 bp, Artificial Sequence
  Description of Artificial Sequence: Synthetic oligonucleotide
accgttgtggtaaactgcac

SEQ ID NO: 2678 - DNA, 20 bp, Artificial Sequence
  Description of Artificial Sequence: Synthetic oligonucleotide
tccgtcattcgtcattgccc

SEQ ID NO: 2679 - DNA, 20 bp, Artificial Sequence
  Description of Artificial Sequence: Synthetic oligonucleotide
gtacaaacaccatgaggctg

SEQ ID NO: 2680 - DNA, 19 bp, Artificial Sequence
  Description of Artificial Sequence: Synthetic oligonucleotide
tgtgatctgtcgtcgcgta

SEQ ID NO: 2681 - DNA, 19 bp, Artificial Sequence
  Description of Artificial Sequence: Synthetic oligonucleotide
ccgtccacagtctactgtg

SEQ ID NO: 2682 - DNA, 20 bp, Artificial Sequence
  Description of Artificial Sequence: Synthetic oligonucleotide
catctgactccccagcgtac

SEQ ID NO: 2683 - DNA, 20 bp, Artificial Sequence
  Description of Artificial Sequence: Synthetic oligonucleotide
cagtagtggtcttgcgtccc

SEQ ID NO: 2684 - DNA, 20 bp, Artificial Sequence
  Description of Artificial Sequence: Synthetic oligonucleotide
gttgaagggtgatgtgtccg

SEQ ID NO: 2685 - DNA, 20 bp, Artificial Sequence
  Description of Artificial Sequence: Synthetic oligonucleotide
ttcgagagacttatccgtgt

SEQ ID NO: 2686 - DNA, 20 bp, Artificial Sequence
  Description of Artificial Sequence: Synthetic oligonucleotide
ccgcttacgaaaatgatctg

SEQ ID NO: 2687 - DNA, 20 bp, Artificial Sequence
  Description of Artificial Sequence: Synthetic oligonucleotide
tgtgcctgtctgtacacgta

SEQ ID NO: 2688 - DNA, 20 bp, Artificial Sequence
  Description of Artificial Sequence: Synthetic oligonucleotide
ctaggatataaactgatctg

SEQ ID NO: 2689 - DNA, 20 bp, Artificial Sequence
  Description of Artificial Sequence: Synthetic oligonucleotide
actcctcttcgatgtgggta

SEQ ID NO: 2690 - DNA, 20 bp, Artificial Sequence
  Description of Artificial Sequence: Synthetic oligonucleotide
ttggaaggggggtgggtccg

SEQ ID NO: 2691 - DNA, 20 bp, Artificial Sequence
  Description of Artificial Sequence: Synthetic oligonucleotide
cattcgcagtccgttggccc

SEQ ID NO: 2692 - DNA, 19 bp, Artificial Sequence
  Description of Artificial Sequence: Synthetic oligonucleotide
tgtgagctcattccgttgc

SEQ ID NO: 2693 - DNA, 20 bp, Artificial Sequence
  Description of Artificial Sequence: Synthetic oligonucleotide
ttttactcctgcctcccccc

SEQ ID NO: 2694 - DNA, 20 bp, Artificial Sequence
  Description of Artificial Sequence: Synthetic oligonucleotide
tccgtgaatttcctgcaccc

SEQ ID NO: 2695 - DNA, 20 bp, Artificial Sequence
  Description of Artificial Sequence: Synthetic oligonucleotide
tcgttcaagtgaccatgccc

SEQ ID NO: 2696 - DNA, 20 bp, Artificial Sequence
  Description of Artificial Sequence: Synthetic oligonucleotide
tttggtgaggggtgggactg

SEQ ID NO: 2697 - DNA, 20 bp, Artificial Sequence
  Description of Artificial Sequence: Synthetic oligonucleotide
cagaagtcccgatttgccgt

SEQ ID NO: 2698 - DNA, 20 bp, Artificial Sequence
  Description of Artificial Sequence: Synthetic oligonucleotide
gtgtttcgtctaccagtgcc

SEQ ID NO: 2699 - DNA, 20 bp, Artificial Sequence
  Description of Artificial Sequence: Synthetic oligonucleotide
tttggagtgggatgggaccg

SEQ ID NO: 2700 - DNA, 20 bp, Artificial Sequence
  Description of Artificial Sequence: Synthetic oligonucleotide
aagcaacaactagccgcgtc

SEQ ID NO: 2701 - DNA, 20 bp, Artificial Sequence
  Description of Artificial Sequence: Synthetic oligonucleotide
tgtcgatggttgcagctggc

SEQ ID NO: 2702 - DNA, 20 bp, Artificial Sequence
  Description of Artificial Sequence: Synthetic oligonucleotide
tgggacatagcttccttgtg

SEQ ID NO: 2703 - DNA, 20 bp, Artificial Sequence
  Description of Artificial Sequence: Synthetic oligonucleotide
tttggggtagggtggtaccg

SEQ ID NO: 2704 - DNA, 20 bp, Artificial Sequence
  Description of Artificial Sequence: Synthetic oligonucleotide
taggcgccgtcttatgtgtg

SEQ ID NO: 2705 - DNA, 19 bp, Artificial Sequence
  Description of Artificial Sequence: Synthetic oligonucleotide
ctattggtgaagggaggtg

SEQ ID NO: 2706 - DNA, 20 bp, Artificial Sequence
  Description of Artificial Sequence: Synthetic oligonucleotide
gatgacggcgactcggtaac

SEQ ID NO: 2707 - DNA, 20 bp, Artificial Sequence
  Description of Artificial Sequence: Synthetic oligonucleotide
tctgaatggtgatgggtccg

SEQ ID NO: 2708 - DNA, 20 bp, Artificial Sequence
  Description of Artificial Sequence: Synthetic oligonucleotide
gttgaatggtgatgggtccg

SEQ ID NO: 2709 - DNA, 20 bp, Artificial Sequence
  Description of Artificial Sequence: Synthetic oligonucleotide
tttgaaggatgctgggtccg

SEQ ID NO: 2710 - DNA, 20 bp, Artificial Sequence
  Description of Artificial Sequence: Synthetic oligonucleotide
aaggtgtgtcgtgctgtgtc

SEQ ID NO: 2711 - DNA, 20 bp, Artificial Sequence
  Description of Artificial Sequence: Synthetic oligonucleotide
acatacacttgtgtcccgta

SEQ ID NO: 2712 - DNA, 20 bp, Artificial Sequence
  Description of Artificial Sequence: Synthetic oligonucleotide
tttggagggggaagggactg

SEQ ID NO: 2713 - DNA, 20 bp, Artificial Sequence
  Description of Artificial Sequence: Synthetic oligonucleotide
cgaatcgtactcgtgttctg

SEQ ID NO: 2714 - DNA, 20 bp, Artificial Sequence
  Description of Artificial Sequence: Synthetic oligonucleotide
tttgaagggggatgcgtccg

SEQ ID NO: 2715 - DNA, 20 bp, Artificial Sequence
  Description of Artificial Sequence: Synthetic oligonucleotide
ttttgagggtgatgggtccg

SEQ ID NO: 2716 - DNA, 20 bp, Artificial Sequence
  Description of Artificial Sequence: Synthetic oligonucleotide
tgtaggacgaggaggtaccg

SEQ ID NO: 2717 - DNA, 20 bp, Artificial Sequence
  Description of Artificial Sequence: Synthetic oligonucleotide
tcggttgctgcttctgtccc

SEQ ID NO: 2718 - DNA, 20 bp, Artificial Sequence
  Description of Artificial Sequence: Synthetic oligonucleotide
atacactcaaaccagtgctc

SEQ ID NO: 2719 - DNA, 20 bp, Artificial Sequence
  Description of Artificial Sequence: Synthetic oligonucleotide
tccatcagagtctgttcccc

SEQ ID NO: 2720 - DNA, 20 bp, Artificial Sequence
  Description of Artificial Sequence: Synthetic oligonucleotide
tttgaaaggggatgggtccg

SEQ ID NO: 2721 - DNA, 20 bp, Artificial Sequence
  Description of Artificial Sequence: Synthetic oligonucleotide
tcctcgttgcatacgcactg

SEQ ID NO: 2722 - DNA, 20 bp, Artificial Sequence
  Description of Artificial Sequence: Synthetic oligonucleotide
tttgaagtgtgttgggtccg

SEQ ID NO: 2723 - DNA, 20 bp, Artificial Sequence
  Description of Artificial Sequence: Synthetic oligonucleotide
taaactgtgacagttggtgg

SEQ ID NO: 2724 - DNA, 20 bp, Artificial Sequence
  Description of Artificial Sequence: Synthetic oligonucleotide
tttgaagggtgatggaaccg

SEQ ID NO: 2725 - DNA, 20 bp, Artificial Sequence
  Description of Artificial Sequence: Synthetic oligonucleotide
ctgggtgtaggggggtaccg

SEQ ID NO: 2726 - DNA, 20 bp, Artificial Sequence
  Description of Artificial Sequence: Synthetic oligonucleotide
ttgggtgcagtgtggtaccg

SEQ ID NO: 2727 - DNA, 20 bp, Artificial Sequence
  Description of Artificial Sequence: Synthetic oligonucleotide
ttgggagtagggtggttccg

SEQ ID NO: 2728 - DNA, 20 bp, Artificial Sequence
  Description of Artificial Sequence: Synthetic oligonucleotide
aatcgaacgggcacattgcc

SEQ ID NO: 2729 - DNA, 20 bp, Artificial Sequence
  Description of Artificial Sequence: Synthetic oligonucleotide
acatcaagattgtgtaccgc

SEQ ID NO: 2730 - DNA, 20 bp, Artificial Sequence
  Description of Artificial Sequence: Synthetic oligonucleotide
tgggtgagcatgtcatgggc

SEQ ID NO: 2731 - DNA, 20 bp, Artificial Sequence
  Description of Artificial Sequence: Synthetic oligonucleotide
cgattcctctgcttcgtccc

SEQ ID NO: 2732 - DNA, 20 bp, Artificial Sequence
  Description of Artificial Sequence: Synthetic oligonucleotide
tattggaggtgtagcgaccg

SEQ ID NO: 2733 - DNA, 20 bp, Artificial Sequence
  Description of Artificial Sequence: Synthetic oligonucleotide
tcaatgtccacccgcgtcac

SEQ ID NO: 2734 - DNA, 20 bp, Artificial Sequence
  Description of Artificial Sequence: Synthetic oligonucleotide
tggtcttcgattcctccccc

SEQ ID NO: 2735 - DNA, 20 bp, Artificial Sequence
  Description of Artificial Sequence: Synthetic oligonucleotide
tttgaagggggatgggtacg

SEQ ID NO: 2736 - DNA, 20 bp, Artificial Sequence
  Description of Artificial Sequence: Synthetic oligonucleotide
ttttaagggggatgggtccg

SEQ ID NO: 2737 - DNA, 20 bp, Artificial Sequence
  Description of Artificial Sequence: Synthetic oligonucleotide
gtatgtccactgggttggcc

SEQ ID NO: 2738 - DNA, 20 bp, Artificial Sequence
  Description of Artificial Sequence: Synthetic oligonucleotide
tattggaggtttagggaccg

SEQ ID NO: 2739 - DNA, 19 bp, Artificial Sequence
  Description of Artificial Sequence: Synthetic oligonucleotide
tttccttccctgaactggc

SEQ ID NO: 2740 - DNA, 20 bp, Artificial Sequence
  Description of Artificial Sequence: Synthetic oligonucleotide
cttgtcatcttgttcgtccc

SEQ ID NO: 2741 - DNA, 20 bp, Artificial Sequence
  Description of Artificial Sequence: Synthetic oligonucleotide
atgatcgtgcaccctgtggt

SEQ ID NO: 2742 - DNA, 20 bp, Artificial Sequence
  Description of Artificial Sequence: Synthetic oligonucleotide
agccgcacaagtattgtggc

SEQ ID NO: 2743 - DNA, 20 bp, Artificial Sequence
  Description of Artificial Sequence: Synthetic oligonucleotide
aatggcccataacgtatctg

SEQ ID NO: 2744 - DNA, 20 bp, Artificial Sequence
  Description of Artificial Sequence: Synthetic oligonucleotide
catcaacctccgtcctaccc

SEQ ID NO: 2745 - DNA, 20 bp, Artificial Sequence
  Description of Artificial Sequence: Synthetic oligonucleotide
attggtgaatggagggactg

SEQ ID NO: 2746 - DNA, 20 bp, Artificial Sequence
  Description of Artificial Sequence: Synthetic oligonucleotide
tcattcatcatgtttagctg

SEQ ID NO: 2747 - DNA, 20 bp, Artificial Sequence
  Description of Artificial Sequence: Synthetic oligonucleotide
atcggtgaagggaggcactg

SEQ ID NO: 2748 - DNA, 20 bp, Artificial Sequence
  Description of Artificial Sequence: Synthetic oligonucleotide
tttgaagggtgaatggtccg

SEQ ID NO: 2749 - DNA, 20 bp, Artificial Sequence
  Description of Artificial Sequence: Synthetic oligonucleotide
aagttcctcgtgtcgttgac

SEQ ID NO: 2750 - DNA, 20 bp, Artificial Sequence
  Description of Artificial Sequence: Synthetic oligonucleotide
acaatacactgtacccgccc

SEQ ID NO: 2751 - DNA, 20 bp, Artificial Sequence
  Description of Artificial Sequence: Synthetic oligonucleotide
gatccatcaatggtttgcgc

SEQ ID NO: 2752 - DNA, 20 bp, Artificial Sequence
  Description of Artificial Sequence: Synthetic oligonucleotide
tctttcctcttgtcgtgcac

SEQ ID NO: 2753 - DNA, 20 bp, Artificial Sequence
  Description of Artificial Sequence: Synthetic oligonucleotide
attggtggaggggggtactg

SEQ ID NO: 2754 - DNA, 20 bp, Artificial Sequence
  Description of Artificial Sequence: Synthetic oligonucleotide
tttgaagggttattggtccg

SEQ ID NO: 2755 - DNA, 20 bp, Artificial Sequence
  Description of Artificial Sequence: Synthetic oligonucleotide
aaagaaagtcacacaatctg

SEQ ID NO: 2756 - DNA, 20 bp, Artificial Sequence
  Description of Artificial Sequence: Synthetic oligonucleotide
acacaactcttggagtggcc

SEQ ID NO: 2757 - DNA, 19 bp, Artificial Sequence
  Description of Artificial Sequence: Synthetic oligonucleotide
gtccttctgtcgtatggta

SEQ ID NO: 2758 - DNA, 20 bp, Artificial Sequence
  Description of Artificial Sequence: Synthetic oligonucleotide
tttgtagggtgatgggtccc

SEQ ID NO: 2759 - DNA, 20 bp, Artificial Sequence
  Description of Artificial Sequence: Synthetic oligonucleotide
tttgaagtgtgatgggaccg

SEQ ID NO: 2760 - DNA, 20 bp, Artificial Sequence
  Description of Artificial Sequence: Synthetic oligonucleotide
ttcatggactatagcacccc

SEQ ID NO: 2761 - DNA, 20 bp, Artificial Sequence
  Description of Artificial Sequence: Synthetic oligonucleotide
ccgcatgatctacctctgca

SEQ ID NO: 2762 - DNA, 20 bp, Artificial Sequence
  Description of Artificial Sequence: Synthetic oligonucleotide
tcggttcgttctgtcatccc

SEQ ID NO: 2763 - DNA, 20 bp, Artificial Sequence
  Description of Artificial Sequence: Synthetic oligonucleotide
tctttgcctcccttggttgc

SEQ ID NO: 2764 - DNA, 20 bp, Artificial Sequence
  Description of Artificial Sequence: Synthetic oligonucleotide
ggcgaagtttataacggctg

SEQ ID NO: 2765 - DNA, 20 bp, Artificial Sequence
  Description of Artificial Sequence: Synthetic oligonucleotide
tttgaagggtgatgggacgg

SEQ ID NO: 2766 - DNA, 20 bp, Artificial Sequence
  Description of Artificial Sequence: Synthetic oligonucleotide
gtgtctgatttgcctccccc

SEQ ID NO: 2767 - DNA, 20 bp, Artificial Sequence
  Description of Artificial Sequence: Synthetic oligonucleotide
ttgggagtcgggtggtaccg

SEQ ID NO: 2768 - DNA, 21 bp, Artificial Sequence
  Description of Artificial Sequence: Synthetic oligonucleotide
ttttgaagggtgatgggtcca

SEQ ID NO: 2769 - DNA, 20 bp, Artificial Sequence
  Description of Artificial Sequence: Synthetic oligonucleotide
tactcctgatcgtcagtgcc

SEQ ID NO: 2770 - DNA, 20 bp, Artificial Sequence
  Description of Artificial Sequence: Synthetic oligonucleotide
tcacggatggaggtgatgtg

SEQ ID NO: 2771 - DNA, 18 bp, Artificial Sequence
  Description of Artificial Sequence: Synthetic oligonucleotide
gcctttcgttctgcctcc

SEQ ID NO: 2772 - DNA, 20 bp, Artificial Sequence
  Description of Artificial Sequence: Synthetic oligonucleotide
tcgggtgtagggtgttaccg

SEQ ID NO: 2773 - DNA, 20 bp, Artificial Sequence
  Description of Artificial Sequence: Synthetic oligonucleotide
tttgaagggtgatagggccg

SEQ ID NO: 2774 - DNA, 20 bp, Artificial Sequence
  Description of Artificial Sequence: Synthetic oligonucleotide
gaaaagtgaataggctaccc

SEQ ID NO: 2775 - DNA, 19 bp, Artificial Sequence
  Description of Artificial Sequence: Synthetic oligonucleotide
ttggtttagggtggtaccg

SEQ ID NO: 2776 - DNA, 20 bp, Artificial Sequence
  Description of Artificial Sequence: Synthetic oligonucleotide
accgtttcgtcgccaagcac

SEQ ID NO: 2777 - DNA, 20 bp, Artificial Sequence
  Description of Artificial Sequence: Synthetic oligonucleotide
aattcatttcctcccccccc

SEQ ID NO: 2778 - DNA, 20 bp, Artificial Sequence
  Description of Artificial Sequence: Synthetic oligonucleotide
ttgggtatagggtggtactg

SEQ ID NO: 2779 - DNA, 20 bp, Artificial Sequence
  Description of Artificial Sequence: Synthetic oligonucleotide
tccaggcagaatcgtcacca

SEQ ID NO: 2780 - DNA, 20 bp, Artificial Sequence
  Description of Artificial Sequence: Synthetic oligonucleotide
tcttccgaagcgtggttctg

SEQ ID NO: 2781 - DNA, 20 bp, Artificial Sequence
  Description of Artificial Sequence: Synthetic oligonucleotide
tttccctttcgactgctgcc

SEQ ID NO: 2782 - DNA, 20 bp, Artificial Sequence
  Description of Artificial Sequence: Synthetic oligonucleotide
tccctcttttgttcgtggtc

SEQ ID NO: 2783 - DNA, 20 bp, Artificial Sequence
  Description of Artificial Sequence: Synthetic oligonucleotide
ttggaaggggggtggtaccg

SEQ ID NO: 2784 - DNA, 20 bp, Artificial Sequence
  Description of Artificial Sequence: Synthetic oligonucleotide
ttcactccaaaacacaccgc

SEQ ID NO: 2785 - DNA, 20 bp, Artificial Sequence
  Description of Artificial Sequence: Synthetic oligonucleotide
tcagtgtgataatattgcgg

SEQ ID NO: 2786 - DNA, 20 bp, Artificial Sequence
  Description of Artificial Sequence: Synthetic oligonucleotide
tttggtgtatggtggtaccg

SEQ ID NO: 2787 - DNA, 20 bp, Artificial Sequence
  Description of Artificial Sequence: Synthetic oligonucleotide
gttggtgaagggagggactg

SEQ ID NO: 2788 - DNA, 20 bp, Artificial Sequence
  Description of Artificial Sequence: Synthetic oligonucleotide
cctgatgttactattcgtgc

SEQ ID NO: 2789 - DNA, 20 bp, Artificial Sequence
  Description of Artificial Sequence: Synthetic oligonucleotide
tgacgagcgtgcgtttggtc

SEQ ID NO: 2790 - DNA, 20 bp, Artificial Sequence
  Description of Artificial Sequence: Synthetic oligonucleotide
ttgggtgtggggtgggaccg

SEQ ID NO: 2791 - DNA, 20 bp, Artificial Sequence
  Description of Artificial Sequence: Synthetic oligonucleotide
ttcaccttttcgatccgccc

SEQ ID NO: 2792 - DNA, 20 bp, Artificial Sequence
  Description of Artificial Sequence: Synthetic oligonucleotide
tttgacgggtgatgggaccg

SEQ ID NO: 2793 - DNA, 20 bp, Artificial Sequence
  Description of Artificial Sequence: Synthetic oligonucleotide
actagcatcacggttgtcca

SEQ ID NO: 2794 - DNA, 18 bp, Artificial Sequence
  Description of Artificial Sequence: Synthetic oligonucleotide
ttgggtgtggtggtaccg

SEQ ID NO: 2795 - DNA, 20 bp, Artificial Sequence
  Description of Artificial Sequence: Synthetic oligonucleotide
cagaggttggtcgtcgaggc

SEQ ID NO: 2796 - DNA, 20 bp, Artificial Sequence
  Description of Artificial Sequence: Synthetic oligonucleotide
gttttacaaggtacagtctg

SEQ ID NO: 2797 - DNA, 20 bp, Artificial Sequence
  Description of Artificial Sequence: Synthetic oligonucleotide
tttgaagggtgatgcctccg

SEQ ID NO: 2798 - DNA, 20 bp, Artificial Sequence
  Description of Artificial Sequence: Synthetic oligonucleotide
tttgaaggaggatgggactg

SEQ ID NO: 2799 - DNA, 20 bp, Artificial Sequence
  Description of Artificial Sequence: Synthetic oligonucleotide
aatcctctgtgttgtctggc

SEQ ID NO: 2800 - DNA, 20 bp, Artificial Sequence
  Description of Artificial Sequence: Synthetic oligonucleotide
gcagggaaactcttgacgcc

SEQ ID NO: 2801 - DNA, 20 bp, Artificial Sequence
  Description of Artificial Sequence: Synthetic oligonucleotide
tttgcagggtgatgcgtccg

SEQ ID NO: 2802 - DNA, 20 bp, Artificial Sequence
  Description of Artificial Sequence: Synthetic oligonucleotide
tcgggtcgtgcgtgtgttgc

SEQ ID NO: 2803 - DNA, 20 bp, Artificial Sequence
  Description of Artificial Sequence: Synthetic oligonucleotide
tcctcatgtctatgtctccg

SEQ ID NO: 2804 - DNA, 20 bp, Artificial Sequence
  Description of Artificial Sequence: Synthetic oligonucleotide
tccaacgtcgattctgttgc

SEQ ID NO: 2805 - DNA, 20 bp, Artificial Sequence
  Description of Artificial Sequence: Synthetic oligonucleotide
tcattcccttagcgactccg

SEQ ID NO: 2806 - DNA, 20 bp, Artificial Sequence
  Description of Artificial Sequence: Synthetic oligonucleotide
acagccctatattgttaccg

SEQ ID NO: 2807 - DNA, 20 bp, Artificial Sequence
  Description of Artificial Sequence: Synthetic oligonucleotide
tttgaaggttgttgggtccg

SEQ ID NO: 2808 - DNA, 20 bp, Artificial Sequence
  Description of Artificial Sequence: Synthetic oligonucleotide
gcttatcttcgtttgtgcgc

SEQ ID NO: 2809 - DNA, 20 bp, Artificial Sequence
  Description of Artificial Sequence: Synthetic oligonucleotide
tcatcctatgtagtgttgtg

SEQ ID NO: 2810 - DNA, 20 bp, Artificial Sequence
  Description of Artificial Sequence: Synthetic oligonucleotide
tccttaagcgtactggtgcc

SEQ ID NO: 2811 - DNA, 20 bp, Artificial Sequence
  Description of Artificial Sequence: Synthetic oligonucleotide
ggatggttgtggctatacgc

SEQ ID NO: 2812 - DNA, 20 bp, Artificial Sequence
  Description of Artificial Sequence: Synthetic oligonucleotide
gtccgtctgacttatccctg

SEQ ID NO: 2813 - DNA, 20 bp, Artificial Sequence
  Description of Artificial Sequence: Synthetic oligonucleotide
tcctgcgtaaactcgtgccg

SEQ ID NO: 2814 - DNA, 20 bp, Artificial Sequence
  Description of Artificial Sequence: Synthetic oligonucleotide
tattgccacggggcaatagc

SEQ ID NO: 2815 - DNA, 20 bp, Artificial Sequence
  Description of Artificial Sequence: Synthetic oligonucleotide
tatcgaaacagtctggtctg

SEQ ID NO: 2816 - DNA, 20 bp, Artificial Sequence
  Description of Artificial Sequence: Synthetic oligonucleotide
tgggcatgagatcgtaggac

SEQ ID NO: 2817 - DNA, 20 bp, Artificial Sequence
  Description of Artificial Sequence: Synthetic oligonucleotide
gcgaaatgtcgtgctctccc

SEQ ID NO: 2818 - DNA, 20 bp, Artificial Sequence
  Description of Artificial Sequence: Synthetic oligonucleotide
ttgggagtagggtgggtccg

SEQ ID NO: 2819 - DNA, 20 bp, Artificial Sequence
  Description of Artificial Sequence: Synthetic oligonucleotide
gaccgcgatccatctccgta

SEQ ID NO: 2820 - DNA, 20 bp, Artificial Sequence
  Description of Artificial Sequence: Synthetic oligonucleotide
tcagttagtcccgtccgtgc

SEQ ID NO: 2821 - DNA, 20 bp, Artificial Sequence
  Description of Artificial Sequence: Synthetic oligonucleotide
agtggactatgatgatggcc

SEQ ID NO: 2822 - DNA, 20 bp, Artificial Sequence
  Description of Artificial Sequence: Synthetic oligonucleotide
tcttcgaaaaccgagttgtg

SEQ ID NO: 2823 - DNA, 20 bp, Artificial Sequence
  Description of Artificial Sequence: Synthetic oligonucleotide
agtggcctataccacttggc

SEQ ID NO: 2824 - DNA, 20 bp, Artificial Sequence
  Description of Artificial Sequence: Synthetic oligonucleotide
gaaagcacactggacttgtg

SEQ ID NO: 2825 - DNA, 20 bp, Artificial Sequence
  Description of Artificial Sequence: Synthetic oligonucleotide
tgttgttagtctgatgttgc

SEQ ID NO: 2826 - DNA, 20 bp, Artificial Sequence
  Description of Artificial Sequence: Synthetic oligonucleotide
ttagagcttgcattgggcac

SEQ ID NO: 2827 - DNA, 20 bp, Artificial Sequence
  Description of Artificial Sequence: Synthetic oligonucleotide
cgttgtcttcttcacgtgtc

SEQ ID NO: 2828 - DNA, 20 bp, Artificial Sequence
  Description of Artificial Sequence: Synthetic oligonucleotide
tgaaacaaatctatgctccc

SEQ ID NO: 2829 - DNA, 20 bp, Artificial Sequence
  Description of Artificial Sequence: Synthetic oligonucleotide
gtacgtgtgagcaatgtggc

SEQ ID NO: 2830 - DNA, 20 bp, Artificial Sequence
  Description of Artificial Sequence: Synthetic oligonucleotide
acgatgatcgtctgtacggc

SEQ ID NO: 2831 - DNA, 20 bp, Artificial Sequence
  Description of Artificial Sequence: Synthetic oligonucleotide
tcgcagaaaggatgcgtgcc

SEQ ID NO: 2832 - DNA, 20 bp, Artificial Sequence
  Description of Artificial Sequence: Synthetic oligonucleotide
tactgaaaacaaactgtctg

SEQ ID NO: 2833 - DNA, 20 bp, Artificial Sequence
  Description of Artificial Sequence: Synthetic oligonucleotide
ttgggcgtatggtggtaccg

SEQ ID NO: 2834 - DNA, 20 bp, Artificial Sequence
  Description of Artificial Sequence: Synthetic oligonucleotide
tttgaagagtgatgggaccg

SEQ ID NO: 2835 - DNA, 20 bp, Artificial Sequence
  Description of Artificial Sequence: Synthetic oligonucleotide
gccgttatctggtgtgcgtg

SEQ ID NO: 2836 - DNA, 20 bp, Artificial Sequence
  Description of Artificial Sequence: Synthetic oligonucleotide
tttgaagggtgatgggtcta

SEQ ID NO: 2837 - DNA, 20 bp, Artificial Sequence
  Description of Artificial Sequence: Synthetic oligonucleotide
gcttcaaagtcttccgtgtg

SEQ ID NO: 2838 - DNA, 20 bp, Artificial Sequence
  Description of Artificial Sequence: Synthetic oligonucleotide
tcctgtcgtttttgcgtccc

SEQ ID NO: 2839 - DNA, 20 bp, Artificial Sequence
  Description of Artificial Sequence: Synthetic oligonucleotide
aactagccgagcggtatcgc

SEQ ID NO: 2840 - DNA, 20 bp, Artificial Sequence
  Description of Artificial Sequence: Synthetic oligonucleotide
ttacaacacgtccccatccc

SEQ ID NO: 2841 - DNA, 20 bp, Artificial Sequence
  Description of Artificial Sequence: Synthetic oligonucleotide
taagcaactccatgatactg

SEQ ID NO: 2842 - DNA, 20 bp, Artificial Sequence
  Description of Artificial Sequence: Synthetic oligonucleotide
tttgagcggtgatgggtccg

SEQ ID NO: 2843 - DNA, 20 bp, Artificial Sequence
  Description of Artificial Sequence: Synthetic oligonucleotide
gccgcgtctagccttcgtac

SEQ ID NO: 2844 - DNA, 20 bp, Artificial Sequence
  Description of Artificial Sequence: Synthetic oligonucleotide
gttagtccaaatcgcgtgta

SEQ ID NO: 2845 - DNA, 20 bp, Artificial Sequence
  Description of Artificial Sequence: Synthetic oligonucleotide
gacagtgttaaaaggggccg

SEQ ID NO: 2846 - DNA, 20 bp, Artificial Sequence
  Description of Artificial Sequence: Synthetic oligonucleotide
gcctttcgttctgctctacc

SEQ ID NO: 2847 - DNA, 20 bp, Artificial Sequence
  Description of Artificial Sequence: Synthetic oligonucleotide
tcgtacgagtgcatctggtg

SEQ ID NO: 2848 - DNA, 20 bp, Artificial Sequence
  Description of Artificial Sequence: Synthetic oligonucleotide
gcttacgtctcaatccaccc

SEQ ID NO: 2849 - DNA, 20 bp, Artificial Sequence
  Description of Artificial Sequence: Synthetic oligonucleotide
gtgggtgtagggcggtaccg

SEQ ID NO: 2850 - DNA, 20 bp, Artificial Sequence
  Description of Artificial Sequence: Synthetic oligonucleotide
taagcaaaactatacagccg

SEQ ID NO: 2851 - DNA, 20 bp, Artificial Sequence
  Description of Artificial Sequence: Synthetic oligonucleotide
aacactataccacgggactg

SEQ ID NO: 2852 - DNA, 20 bp, Artificial Sequence
  Description of Artificial Sequence: Synthetic oligonucleotide
acgagactgcggcctgtgac

SEQ ID NO: 2853 - DNA, 20 bp, Artificial Sequence
  Description of Artificial Sequence: Synthetic oligonucleotide
gttgtcatgtttgagctgtg

SEQ ID NO: 2854 - DNA, 20 bp, Artificial Sequence
  Description of Artificial Sequence: Synthetic oligonucleotide
gcataacgtactggtcaccc

SEQ ID NO: 2855 - DNA, 20 bp, Artificial Sequence
  Description of Artificial Sequence: Synthetic oligonucleotide
ttcctttcctcccgttttgc

SEQ ID NO: 2856 - DNA, 20 bp, Artificial Sequence
  Description of Artificial Sequence: Synthetic oligonucleotide
ttgatttaggttgggtgctg

SEQ ID NO: 2857 - DNA, 20 bp, Artificial Sequence
  Description of Artificial Sequence: Synthetic oligonucleotide
acgtggtgtagggaggtgtc

SEQ ID NO: 2858 - DNA, 20 bp, Artificial Sequence
  Description of Artificial Sequence: Synthetic oligonucleotide
cttgtcgtcttgttcgtgcc

SEQ ID NO: 2859 - DNA, 19 bp, Artificial Sequence
  Description of Artificial Sequence: Synthetic oligonucleotide
actagtaaacctccgtggc

SEQ ID NO: 2860 - DNA, 20 bp, Artificial Sequence
  Description of Artificial Sequence: Synthetic oligonucleotide
agtttgatgttgatggtgtg

SEQ ID NO: 2861 - DNA, 20 bp, Artificial Sequence
  Description of Artificial Sequence: Synthetic oligonucleotide
tttgaagggtgatgcggccg

SEQ ID NO: 2862 - DNA, 20 bp, Artificial Sequence
  Description of Artificial Sequence: Synthetic oligonucleotide
ttgggtggagggtggcaccg

SEQ ID NO: 2863 - DNA, 20 bp, Artificial Sequence
  Description of Artificial Sequence: Synthetic oligonucleotide
tctttgtcgtcttgcgtccc

SEQ ID NO: 2864 - DNA, 20 bp, Artificial Sequence
  Description of Artificial Sequence: Synthetic oligonucleotide
tattcgatttcgtcgtggtc

SEQ ID NO: 2865 - DNA, 20 bp, Artificial Sequence
  Description of Artificial Sequence: Synthetic oligonucleotide
taatttcgtcctaacgtccc

SEQ ID NO: 2866 - DNA, 20 bp, Artificial Sequence
  Description of Artificial Sequence: Synthetic oligonucleotide
ttgggtgtggggtggttccg

SEQ ID NO: 2867 - DNA, 20 bp, Artificial Sequence
  Description of Artificial Sequence: Synthetic oligonucleotide
tttgaggggtgttgggtccg

SEQ ID NO: 2868 - DNA, 20 bp, Artificial Sequence
  Description of Artificial Sequence: Synthetic oligonucleotide
taaccgaaatctgtagtgtg

SEQ ID NO: 2869 - DNA, 20 bp, Artificial Sequence
  Description of Artificial Sequence: Synthetic oligonucleotide
ataaggagaagggtgaaccg

SEQ ID NO: 2870 - DNA, 20 bp, Artificial Sequence
  Description of Artificial Sequence: Synthetic oligonucleotide
atagggagaagggtaaaccg

SEQ ID NO: 2871 - DNA, 20 bp, Artificial Sequence
  Description of Artificial Sequence: Synthetic oligonucleotide
ttgggtgtagggtggtaatg

SEQ ID NO: 2872 - DNA, 20 bp, Artificial Sequence
  Description of Artificial Sequence: Synthetic oligonucleotide
gttcaacagccgcctttgtg

SEQ ID NO: 2873 - DNA, 20 bp, Artificial Sequence
  Description of Artificial Sequence: Synthetic oligonucleotide
atagggtgaagggtgaaccg

SEQ ID NO: 2874 - DNA, 20 bp, Artificial Sequence
  Description of Artificial Sequence: Synthetic oligonucleotide
tttggggggtgatgggaccg

SEQ ID NO: 2875 - DNA, 20 bp, Artificial Sequence
  Description of Artificial Sequence: Synthetic oligonucleotide
ttctttcgtccccttatgtg

SEQ ID NO: 2876 - DNA, 20 bp, Artificial Sequence
  Description of Artificial Sequence: Synthetic oligonucleotide
caatcaaactgtcttccccc

SEQ ID NO: 2877 - DNA, 20 bp, Artificial Sequence
  Description of Artificial Sequence: Synthetic oligonucleotide
atccgcttctcccttggcac

SEQ ID NO: 2878 - DNA, 20 bp, Artificial Sequence
  Description of Artificial Sequence: Synthetic oligonucleotide
tgtgctgtgtactatgtgta

SEQ ID NO: 2879 - DNA, 20 bp, Artificial Sequence
  Description of Artificial Sequence: Synthetic oligonucleotide
ttgggtgtagggtaataccg

SEQ ID NO: 2880 - DNA, 20 bp, Artificial Sequence
  Description of Artificial Sequence: Synthetic oligonucleotide
gaggcgtgttctctggtcgc

SEQ ID NO: 2881 - DNA, 20 bp, Artificial Sequence
  Description of Artificial Sequence: Synthetic oligonucleotide
tccaaatatgtcgcgctccc

SEQ ID NO: 2882 - DNA, 20 bp, Artificial Sequence
  Description of Artificial Sequence: Synthetic oligonucleotide
gttgaagggtgatgggtcgg

SEQ ID NO: 2883 - DNA, 20 bp, Artificial Sequence
  Description of Artificial Sequence: Synthetic oligonucleotide
aaatgggacgatttcaccag

SEQ ID NO: 2884 - DNA, 20 bp, Artificial Sequence
  Description of Artificial Sequence: Synthetic oligonucleotide
ttcgctgttcatacccaccc

SEQ ID NO: 2885 - DNA, 20 bp, Artificial Sequence
  Description of Artificial Sequence: Synthetic oligonucleotide
tacgggttatatgctctgtg

SEQ ID NO: 2886 - DNA, 20 bp, Artificial Sequence
  Description of Artificial Sequence: Synthetic oligonucleotide
tccggacgcatgttcgactg

SEQ ID NO: 2887 - DNA, 20 bp, Artificial Sequence
  Description of Artificial Sequence: Synthetic oligonucleotide
gccgtcatttaatgtggccc

SEQ ID NO: 2888 - DNA, 20 bp, Artificial Sequence
  Description of Artificial Sequence: Synthetic oligonucleotide
tgcactttgggattggccca

SEQ ID NO: 2889 - DNA, 20 bp, Artificial Sequence
  Description of Artificial Sequence: Synthetic oligonucleotide
tcgtttcccatgtgtgtcac

SEQ ID NO: 2890 - DNA, 20 bp, Artificial Sequence
  Description of Artificial Sequence: Synthetic oligonucleotide
ccattcgcctgtatcgagta

SEQ ID NO: 2891 - DNA, 20 bp, Artificial Sequence
  Description of Artificial Sequence: Synthetic oligonucleotide
gagctcgttctgtgacgctg

SEQ ID NO: 2892 - DNA, 20 bp, Artificial Sequence
  Description of Artificial Sequence: Synthetic oligonucleotide
cactgaactgatggctaccc

SEQ ID NO: 2893 - DNA, 20 bp, Artificial Sequence
  Description of Artificial Sequence: Synthetic oligonucleotide
cacttcatcgaacgactccc

SEQ ID NO: 2894 - DNA, 20 bp, Artificial Sequence
  Description of Artificial Sequence: Synthetic oligonucleotide
catcaaacggggtgagtgcc

SEQ ID NO: 2895 - DNA, 21 bp, Artificial Sequence
  Description of Artificial Sequence: Synthetic oligonucleotide
aaagagctgagtcgctgtgcc

SEQ ID NO: 2896 - DNA, 20 bp, Artificial Sequence
  Description of Artificial Sequence: Synthetic oligonucleotide
tttgcagggtgatgggtccc

SEQ ID NO: 2897 - DNA, 20 bp, Artificial Sequence
  Description of Artificial Sequence: Synthetic oligonucleotide
ttgggtctagggtgttaccg

SEQ ID NO: 2898 - DNA, 18 bp, Artificial Sequence
  Description of Artificial Sequence: Synthetic oligonucleotide
cgtgtcgctcggtctgtg

SEQ ID NO: 2899 - DNA, 20 bp, Artificial Sequence
  Description of Artificial Sequence: Synthetic oligonucleotide
tgaatgctcttctgttggta

SEQ ID NO: 2900 - DNA, 20 bp, Artificial Sequence
  Description of Artificial Sequence: Synthetic oligonucleotide
aaacatgttacaagccgcta

SEQ ID NO: 2901 - DNA, 20 bp, Artificial Sequence
  Description of Artificial Sequence: Synthetic oligonucleotide
gttgatgtgggtattcaccc

SEQ ID NO: 2902 - DNA, 20 bp, Artificial Sequence
  Description of Artificial Sequence: Synthetic oligonucleotide
acatgcgtacggacttgggc

SEQ ID NO: 2903 - DNA, 20 bp, Artificial Sequence
  Description of Artificial Sequence: Synthetic oligonucleotide
attgaaggagggagggactg

SEQ ID NO: 2904 - DNA, 20 bp, Artificial Sequence
  Description of Artificial Sequence: Synthetic oligonucleotide
gtttaagggtgatgggtccg

SEQ ID NO: 2905 - DNA, 20 bp, Artificial Sequence
  Description of Artificial Sequence: Synthetic oligonucleotide
gaacatgacttctctacccc

SEQ ID NO: 2906 - DNA, 20 bp, Artificial Sequence
  Description of Artificial Sequence: Synthetic oligonucleotide
tcatgtcccctatgtaccgc

SEQ ID NO: 2907 - DNA, 20 bp, Artificial Sequence
  Description of Artificial Sequence: Synthetic oligonucleotide
tgggccgtagtgcgtctgtg

SEQ ID NO: 2908 - DNA, 20 bp, Artificial Sequence
  Description of Artificial Sequence: Synthetic oligonucleotide
aataaagtccgacttggctg

SEQ ID NO: 2909 - DNA, 20 bp, Artificial Sequence
  Description of Artificial Sequence: Synthetic oligonucleotide
acctataattagtctgtgtg

SEQ ID NO: 2910 - DNA, 20 bp, Artificial Sequence
  Description of Artificial Sequence: Synthetic oligonucleotide
ttgatgacttatggcacatg

SEQ ID NO: 2911 - DNA, 20 bp, Artificial Sequence
  Description of Artificial Sequence: Synthetic oligonucleotide
tgtagagaggtagttatcgt

SEQ ID NO: 2912 - DNA, 20 bp, Artificial Sequence
  Description of Artificial Sequence: Synthetic oligonucleotide
atacggtgtgtgcttggccc

SEQ ID NO: 2913 - DNA, 21 bp, Artificial Sequence
  Description of Artificial Sequence: Synthetic oligonucleotide
ttgggtgtagggtaggtaccg

SEQ ID NO: 2914 - DNA, 20 bp, Artificial Sequence
  Description of Artificial Sequence: Synthetic oligonucleotide
ggtggtgaagggaggtactg

SEQ ID NO: 2915 - DNA, 20 bp, Artificial Sequence
  Description of Artificial Sequence: Synthetic oligonucleotide
atttagtcctcgggttgctg

SEQ ID NO: 2916 - DNA, 20 bp, Artificial Sequence
  Description of Artificial Sequence: Synthetic oligonucleotide
gtagcacaagtctgcttggc

SEQ ID NO: 2917 - DNA, 20 bp, Artificial Sequence
  Description of Artificial Sequence: Synthetic oligonucleotide
tttgaagagcgatgggtccg

SEQ ID NO: 2918 - DNA, 20 bp, Artificial Sequence
  Description of Artificial Sequence: Synthetic oligonucleotide
tgatcgtcagttctcctgtg

SEQ ID NO: 2919 - DNA, 20 bp, Artificial Sequence
  Description of Artificial Sequence: Synthetic oligonucleotide
tcgaggtaggaatggcgtgc

SEQ ID NO: 2920 - DNA, 20 bp, Artificial Sequence
  Description of Artificial Sequence: Synthetic oligonucleotide
ttgggtgtagggcggtaccc

SEQ ID NO: 2921 - DNA, 20 bp, Artificial Sequence
  Description of Artificial Sequence: Synthetic oligonucleotide
tcacctaacggttacaccat

SEQ ID NO: 2922 - DNA, 18 bp, Artificial Sequence
  Description of Artificial Sequence: Synthetic oligonucleotide
cggtgaagggaggtactg

SEQ ID NO: 2923 - DNA, 20 bp, Artificial Sequence
  Description of Artificial Sequence: Synthetic oligonucleotide
ttagcgttcttcccgggtgc

SEQ ID NO: 2924 - DNA, 20 bp, Artificial Sequence
  Description of Artificial Sequence: Synthetic oligonucleotide
tgattcgtgtactccggccc

SEQ ID NO: 2925 - DNA, 19 bp, Artificial Sequence
  Description of Artificial Sequence: Synthetic oligonucleotide
tttgaagggggatggtccg

SEQ ID NO: 2926 - DNA, 20 bp, Artificial Sequence
  Description of Artificial Sequence: Synthetic oligonucleotide
agaagagttggttgtgcccc

SEQ ID NO: 2927 - DNA, 20 bp, Artificial Sequence
  Description of Artificial Sequence: Synthetic oligonucleotide
acaccgtggtcccaattggc

SEQ ID NO: 2928 - DNA, 20 bp, Artificial Sequence
  Description of Artificial Sequence: Synthetic oligonucleotide
tacgagccgactgcgtacgc

SEQ ID NO: 2929 - DNA, 20 bp, Artificial Sequence
  Description of Artificial Sequence: Synthetic oligonucleotide
tgtccgtttctccccgtaac

SEQ ID NO: 2930 - DNA, 20 bp, Artificial Sequence
  Description of Artificial Sequence: Synthetic oligonucleotide
tctgcggcgtattgcatcac

SEQ ID NO: 2931 - DNA, 20 bp, Artificial Sequence
  Description of Artificial Sequence: Synthetic oligonucleotide
ttcgtttggcgatacgtgtc

SEQ ID NO: 2932 - DNA, 20 bp, Artificial Sequence
  Description of Artificial Sequence: Synthetic oligonucleotide
ttgggtgtagtgcggtaccg

SEQ ID NO: 2933 - DNA, 20 bp, Artificial Sequence
  Description of Artificial Sequence: Synthetic oligonucleotide
gatgtcatggcatgtgtggc

SEQ ID NO: 2934 - DNA, 20 bp, Artificial Sequence
  Description of Artificial Sequence: Synthetic oligonucleotide
cagactagacaatcagtgtg

SEQ ID NO: 2935 - DNA, 20 bp, Artificial Sequence
  Description of Artificial Sequence: Synthetic oligonucleotide
tttgaattgtgatgggtccg

SEQ ID NO: 2936 - DNA, 20 bp, Artificial Sequence
  Description of Artificial Sequence: Synthetic oligonucleotide
catgggaccacaactcactg

SEQ ID NO: 2937 - DNA, 20 bp, Artificial Sequence
  Description of Artificial Sequence: Synthetic oligonucleotide
catggattgacgttgctgtg

SEQ ID NO: 2938 - DNA, 20 bp, Artificial Sequence
  Description of Artificial Sequence: Synthetic oligonucleotide
cagtatgtctgcattggctg

SEQ ID NO: 2939 - DNA, 20 bp, Artificial Sequence
  Description of Artificial Sequence: Synthetic oligonucleotide
tatacggcggcgtggggata

SEQ ID NO: 2940 - DNA, 20 bp, Artificial Sequence
  Description of Artificial Sequence: Synthetic oligonucleotide
atgaggaccattcaccacac

SEQ ID NO: 2941 - DNA, 20 bp, Artificial Sequence
  Description of Artificial Sequence: Synthetic oligonucleotide
tgtgcatatttaacgctctg

SEQ ID NO: 2942 - DNA, 19 bp, Artificial Sequence
  Description of Artificial Sequence: Synthetic oligonucleotide
ttggcgtagggtggtaccg

SEQ ID NO: 2943 - DNA, 20 bp, Artificial Sequence
  Description of Artificial Sequence: Synthetic oligonucleotide
accgtgatcatagtgcgccc

SEQ ID NO: 2944 - DNA, 20 bp, Artificial Sequence
  Description of Artificial Sequence: Synthetic oligonucleotide
tgagttcttgtaaggctcct

SEQ ID NO: 2945 - DNA, 20 bp, Artificial Sequence
  Description of Artificial Sequence: Synthetic oligonucleotide
tccggcttactgatccgcca

SEQ ID NO: 2946 - DNA, 20 bp, Artificial Sequence
  Description of Artificial Sequence: Synthetic oligonucleotide
ccatcgctaataacccgcgc

SEQ ID NO: 2947 - DNA, 20 bp, Artificial Sequence
  Description of Artificial Sequence: Synthetic oligonucleotide
gcattgtatgtggggtggtc

SEQ ID NO: 2948 - DNA, 20 bp, Artificial Sequence
  Description of Artificial Sequence: Synthetic oligonucleotide
atgatcacgttaagcccctg

SEQ ID NO: 2949 - DNA, 20 bp, Artificial Sequence
  Description of Artificial Sequence: Synthetic oligonucleotide
tcttcaaccaaatgtatgcc

SEQ ID NO: 2950 - DNA, 20 bp, Artificial Sequence
  Description of Artificial Sequence: Synthetic oligonucleotide
tttgaagggtgatgggttgg

SEQ ID NO: 2951 - DNA, 20 bp, Artificial Sequence
  Description of Artificial Sequence: Synthetic oligonucleotide
tactgttccgccccgttgta

SEQ ID NO: 2952 - DNA, 20 bp, Artificial Sequence
  Description of Artificial Sequence: Synthetic oligonucleotide
tcttacgtcgctgcagaccc

SEQ ID NO: 2953 - DNA, 20 bp, Artificial Sequence
  Description of Artificial Sequence: Synthetic oligonucleotide
ccgcgtaatcaagccatgtc

SEQ ID NO: 2954 - DNA, 20 bp, Artificial Sequence
  Description of Artificial Sequence: Synthetic oligonucleotide
ggagtgtgattcagcttgtg

SEQ ID NO: 2955 - DNA, 20 bp, Artificial Sequence
  Description of Artificial Sequence: Synthetic oligonucleotide
gcctttcgttcttctctccc

SEQ ID NO: 2956 - DNA, 20 bp, Artificial Sequence
  Description of Artificial Sequence: Synthetic oligonucleotide
tatgatcttgaaatgctgtg

SEQ ID NO: 2957 - DNA, 20 bp, Artificial Sequence
  Description of Artificial Sequence: Synthetic oligonucleotide
aaatcctccaacgtattccc

SEQ ID NO: 2958 - DNA, 19 bp, Artificial Sequence
  Description of Artificial Sequence: Synthetic oligonucleotide
atctaacccgcaagtgccg

SEQ ID NO: 2959 - DNA, 20 bp, Artificial Sequence
  Description of Artificial Sequence: Synthetic oligonucleotide
caatctataggggatgtgtc

SEQ ID NO: 2960 - DNA, 20 bp, Artificial Sequence
  Description of Artificial Sequence: Synthetic oligonucleotide
ttcggtaaaattggatgctg

SEQ ID NO: 2961 - DNA, 20 bp, Artificial Sequence
  Description of Artificial Sequence: Synthetic oligonucleotide
gacctatcataatacaccgc

SEQ ID NO: 2962 - DNA, 19 bp, Artificial Sequence
  Description of Artificial Sequence: Synthetic oligonucleotide
ctattggcgaagggtggtg

SEQ ID NO: 2963 - DNA, 20 bp, Artificial Sequence
  Description of Artificial Sequence: Synthetic oligonucleotide
ctctggatgtcagctgtgtg

SEQ ID NO: 2964 - DNA, 20 bp, Artificial Sequence
  Description of Artificial Sequence: Synthetic oligonucleotide
agcgcacaacccttacgcgt

SEQ ID NO: 2965 - DNA, 20 bp, Artificial Sequence
  Description of Artificial Sequence: Synthetic oligonucleotide
tcactgcagatagcccgctg

SEQ ID NO: 2966 - DNA, 20 bp, Artificial Sequence
  Description of Artificial Sequence: Synthetic oligonucleotide
ctatcaggaaacgatgtggc

SEQ ID NO: 2967 - DNA, 20 bp, Artificial Sequence
  Description of Artificial Sequence: Synthetic oligonucleotide
attcctctcagctcactccc

SEQ ID NO: 2968 - DNA, 20 bp, Artificial Sequence
  Description of Artificial Sequence: Synthetic oligonucleotide
tccatcgttatgccgttccg

SEQ ID NO: 2969 - DNA, 20 bp, Artificial Sequence
  Description of Artificial Sequence: Synthetic oligonucleotide
ttaggtgtagggtggtactg

SEQ ID NO: 2970 - DNA, 20 bp, Artificial Sequence
  Description of Artificial Sequence: Synthetic oligonucleotide
taccgtccaatttcactgcc

SEQ ID NO: 2971 - DNA, 20 bp, Artificial Sequence
  Description of Artificial Sequence: Synthetic oligonucleotide
gaactgtgaaatgtcgcctg

SEQ ID NO: 2972 - DNA, 20 bp, Artificial Sequence
  Description of Artificial Sequence: Synthetic oligonucleotide
tctggaatacaacctgtgcc

SEQ ID NO: 2973 - DNA, 20 bp, Artificial Sequence
  Description of Artificial Sequence: Synthetic oligonucleotide
gcatggtgtttgtaggtgtg

SEQ ID NO: 2974 - DNA, 20 bp, Artificial Sequence
  Description of Artificial Sequence: Synthetic oligonucleotide
aatgtgctccgctccatggt

SEQ ID NO: 2975 - DNA, 20 bp, Artificial Sequence
  Description of Artificial Sequence: Synthetic oligonucleotide
gtgtctaagggttgcgtgcc

SEQ ID NO: 2976 - DNA, 20 bp, Artificial Sequence
  Description of Artificial Sequence: Synthetic oligonucleotide
cttgacgtcttgttcgtccc

SEQ ID NO: 2977 - DNA, 20 bp, Artificial Sequence
  Description of Artificial Sequence: Synthetic oligonucleotide
ttattccgtcctacgtgccc

SEQ ID NO: 2978 - DNA, 20 bp, Artificial Sequence
  Description of Artificial Sequence: Synthetic oligonucleotide
agcgtagttatggcgtgggc

SEQ ID NO: 2979 - DNA, 20 bp, Artificial Sequence
  Description of Artificial Sequence: Synthetic oligonucleotide
accgctcgtagatttgtgcc

SEQ ID NO: 2980 - DNA, 20 bp, Artificial Sequence
  Description of Artificial Sequence: Synthetic oligonucleotide
tactatgtgtagtccatctg

SEQ ID NO: 2981 - DNA, 20 bp, Artificial Sequence
  Description of Artificial Sequence: Synthetic oligonucleotide
ttgatcagaggtggtctgta

SEQ ID NO: 2982 - DNA, 20 bp, Artificial Sequence
  Description of Artificial Sequence: Synthetic oligonucleotide
taacttgtgcgatcgatgtg

SEQ ID NO: 2983 - DNA, 20 bp, Artificial Sequence
  Description of Artificial Sequence: Synthetic oligonucleotide
tgattaactttaactgtgtg

SEQ ID NO: 2984 - DNA, 20 bp, Artificial Sequence
  Description of Artificial Sequence: Synthetic oligonucleotide
tcggctacgtacaatgttgc

SEQ ID NO: 2985 - DNA, 20 bp, Artificial Sequence
  Description of Artificial Sequence: Synthetic oligonucleotide
caggaacgtctgtttgtccc

SEQ ID NO: 2986 - DNA, 20 bp, Artificial Sequence
  Description of Artificial Sequence: Synthetic oligonucleotide
tagagataagaagttgctgt

SEQ ID NO: 2987 - DNA, 20 bp, Artificial Sequence
  Description of Artificial Sequence: Synthetic oligonucleotide
taagtcatctatacgctccc

SEQ ID NO: 2988 - DNA, 20 bp, Artificial Sequence
  Description of Artificial Sequence: Synthetic oligonucleotide
tcatcctcctgtcctgtgtg

SEQ ID NO: 2989 - DNA, 20 bp, Artificial Sequence
  Description of Artificial Sequence: Synthetic oligonucleotide
aactcgagtcgccatttgtg

SEQ ID NO: 2990 - DNA, 20 bp, Artificial Sequence
  Description of Artificial Sequence: Synthetic oligonucleotide
tttgaagggtgatgggggcg

SEQ ID NO: 2991 - DNA, 20 bp, Artificial Sequence
  Description of Artificial Sequence: Synthetic oligonucleotide
atagggagaagggttaaccg

SEQ ID NO: 2992 - DNA, 21 bp, Artificial Sequence
  Description of Artificial Sequence: Synthetic oligonucleotide
gtcctgtcgtctgttcgtcac

SEQ ID NO: 2993 - DNA, 20 bp, Artificial Sequence
  Description of Artificial Sequence: Synthetic oligonucleotide
tctctgtggattttgcaccc

SEQ ID NO: 2994 - DNA, 20 bp, Artificial Sequence
  Description of Artificial Sequence: Synthetic oligonucleotide
catacatgcgtctctaccgt

SEQ ID NO: 2995 - DNA, 18 bp, Artificial Sequence
  Description of Artificial Sequence: Synthetic oligonucleotide
attggtgaagggatactg

SEQ ID NO: 2996 - DNA, 19 bp, Artificial Sequence
  Description of Artificial Sequence: Synthetic oligonucleotide
ttcaagggtgatgggtccg

SEQ ID NO: 2997 - DNA, 20 bp, Artificial Sequence
  Description of Artificial Sequence: Synthetic oligonucleotide
cttagtgtctctggtatgac

SEQ ID NO: 2998 - DNA, 20 bp, Artificial Sequence
  Description of Artificial Sequence: Synthetic oligonucleotide
tggaccttagacagcccgtc

SEQ ID NO: 2999 - DNA, 20 bp, Artificial Sequence
  Description of Artificial Sequence: Synthetic oligonucleotide
ccgcacgtcttttcgtaccg

SEQ ID NO: 3000 - DNA, 20 bp, Artificial Sequence
  Description of Artificial Sequence: Synthetic oligonucleotide
tttgaagggtgattggcccg

SEQ ID NO: 3001 - DNA, 20 bp, Artificial Sequence
  Description of Artificial Sequence: Synthetic oligonucleotide
caacgcatcaagttgtgcgc

SEQ ID NO: 3002 - DNA, 19 bp, Artificial Sequence
  Description of Artificial Sequence: Synthetic oligonucleotide
tttgaagggtgggggtccg

SEQ ID NO: 3003 - DNA, 20 bp, Artificial Sequence
  Description of Artificial Sequence: Synthetic oligonucleotide
aaactcctagtcatgtgccc

SEQ ID NO: 3004 - DNA, 19 bp, Artificial Sequence
  Description of Artificial Sequence: Synthetic oligonucleotide
tcctgtcgtctttgcgtcc

SEQ ID NO: 3005 - DNA, 20 bp, Artificial Sequence
  Description of Artificial Sequence: Synthetic oligonucleotide
gtcacttaacactaatgtac

SEQ ID NO: 3006 - DNA, 20 bp, Artificial Sequence
  Description of Artificial Sequence: Synthetic oligonucleotide
aacattggtataaatgtgcc

SEQ ID NO: 3007 - DNA, 21 bp, Artificial Sequence
  Description of Artificial Sequence: Synthetic oligonucleotide
tccttcaagccttcccctggc

SEQ ID NO: 3008 - DNA, 20 bp, Artificial Sequence
  Description of Artificial Sequence: Synthetic oligonucleotide
tttgaagggtgatggtcccg

SEQ ID NO: 3009 - DNA, 20 bp, Artificial Sequence
  Description of Artificial Sequence: Synthetic oligonucleotide
acgtgcgctgacccacttgc

SEQ ID NO: 3010 - DNA, 20 bp, Artificial Sequence
  Description of Artificial Sequence: Synthetic oligonucleotide
acttagtaactataatgctg

SEQ ID NO: 3011 - DNA, 20 bp, Artificial Sequence
  Description of Artificial Sequence: Synthetic oligonucleotide
tttgaagggtgctggttccg

SEQ ID NO: 3012 - DNA, 20 bp, Artificial Sequence
  Description of Artificial Sequence: Synthetic oligonucleotide
gaatatttgacaccgcgctg

SEQ ID NO: 3013 - DNA, 20 bp, Artificial Sequence
  Description of Artificial Sequence: Synthetic oligonucleotide
gcctttcggtctggcctccc

SEQ ID NO: 3014 - DNA, 20 bp, Artificial Sequence
  Description of Artificial Sequence: Synthetic oligonucleotide
tgagtcctggtcactgttgt

SEQ ID NO: 3015 - DNA, 20 bp, Artificial Sequence
  Description of Artificial Sequence: Synthetic oligonucleotide
tacgagcatgtgacgttgcc

SEQ ID NO: 3016 - DNA, 20 bp, Artificial Sequence
  Description of Artificial Sequence: Synthetic oligonucleotide
ctggattgcacactgtactg

SEQ ID NO: 3017 - DNA, 20 bp, Artificial Sequence
  Description of Artificial Sequence: Synthetic oligonucleotide
tttgaagggttatggggccg

SEQ ID NO: 3018 - DNA, 20 bp, Artificial Sequence
  Description of Artificial Sequence: Synthetic oligonucleotide
atagtctgtgattgttgcgt

SEQ ID NO: 3019 - DNA, 20 bp, Artificial Sequence
  Description of Artificial Sequence: Synthetic oligonucleotide
tacgacataacctctttggc

SEQ ID NO: 3020 - DNA, 20 bp, Artificial Sequence
  Description of Artificial Sequence: Synthetic oligonucleotide
tcgtgttggattcttccccc

SEQ ID NO: 3021 - DNA, 20 bp, Artificial Sequence
  Description of Artificial Sequence: Synthetic oligonucleotide
cgtcaacttgaacatgtcgc

SEQ ID NO: 3022 - DNA, 20 bp, Artificial Sequence
  Description of Artificial Sequence: Synthetic oligonucleotide
aacgcctcctgtgtcgtgat

SEQ ID NO: 3023 - DNA, 20 bp, Artificial Sequence
  Description of Artificial Sequence: Synthetic oligonucleotide
tgactcgtctgtttcgtctc

SEQ ID NO: 3024 - DNA, 20 bp, Artificial Sequence
  Description of Artificial Sequence: Synthetic oligonucleotide
accgaacctatcgctagctg

SEQ ID NO: 3025 - DNA, 20 bp, Artificial Sequence
  Description of Artificial Sequence: Synthetic oligonucleotide
tacgtaatgaaatactgccc

SEQ ID NO: 3026 - DNA, 20 bp, Artificial Sequence
  Description of Artificial Sequence: Synthetic oligonucleotide
ttgattcgaggtgacagccc

SEQ ID NO: 3027 - DNA, 20 bp, Artificial Sequence
  Description of Artificial Sequence: Synthetic oligonucleotide
acagcttatgacaccctccc

SEQ ID NO: 3028 - DNA, 20 bp, Artificial Sequence
  Description of Artificial Sequence: Synthetic oligonucleotide
ctcaacggaccattggccag

SEQ ID NO: 3029 - DNA, 20 bp, Artificial Sequence
  Description of Artificial Sequence: Synthetic oligonucleotide
atcgacacgagttgttcgtg

SEQ ID NO: 3030 - DNA, 20 bp, Artificial Sequence
  Description of Artificial Sequence: Synthetic oligonucleotide
aacgatcagctacgttgcgc

SEQ ID NO: 3031 - DNA, 20 bp, Artificial Sequence
  Description of Artificial Sequence: Synthetic oligonucleotide
cgtttcctctggttagtccc

SEQ ID NO: 3032 - DNA, 20 bp, Artificial Sequence
  Description of Artificial Sequence: Synthetic oligonucleotide
ttgggtgtggggaggtaccg

SEQ ID NO: 3033 - DNA, 20 bp, Artificial Sequence
  Description of Artificial Sequence: Synthetic oligonucleotide
gcctttcgttctgtcctctc

SEQ ID NO: 3034 - DNA, 20 bp, Artificial Sequence
  Description of Artificial Sequence: Synthetic oligonucleotide
tacaacgcgaaacctctgtg

SEQ ID NO: 3035 - DNA, 20 bp, Artificial Sequence
  Description of Artificial Sequence: Synthetic oligonucleotide
cttgaatggtgatgggtccg

SEQ ID NO: 3036 - DNA, 20 bp, Artificial Sequence
  Description of Artificial Sequence: Synthetic oligonucleotide
agagtgtatctgctattatg

SEQ ID NO: 3037 - DNA, 20 bp, Artificial Sequence
  Description of Artificial Sequence: Synthetic oligonucleotide
aggacgactgcgatatgctg

SEQ ID NO: 3038 - DNA, 20 bp, Artificial Sequence
  Description of Artificial Sequence: Synthetic oligonucleotide
ctggatggcgcaagcatgtg

SEQ ID NO: 3039 - DNA, 20 bp, Artificial Sequence
  Description of Artificial Sequence: Synthetic oligonucleotide
tcggaaagctgcttagccgc

SEQ ID NO: 3040 - DNA, 20 bp, Artificial Sequence
  Description of Artificial Sequence: Synthetic oligonucleotide
gacccatccactaacctgtg

SEQ ID NO: 3041 - DNA, 20 bp, Artificial Sequence
  Description of Artificial Sequence: Synthetic oligonucleotide
cctttgtttctgggtatgcc

SEQ ID NO: 3042 - DNA, 20 bp, Artificial Sequence
  Description of Artificial Sequence: Synthetic oligonucleotide
taagtagtttgccaacttgg

SEQ ID NO: 3043 - DNA, 20 bp, Artificial Sequence
  Description of Artificial Sequence: Synthetic oligonucleotide
cgagtgttctgatgtccccc

SEQ ID NO: 3044 - DNA, 21 bp, Artificial Sequence
  Description of Artificial Sequence: Synthetic oligonucleotide
tgttgaagggtgatgggtcct

SEQ ID NO: 3045 - DNA, 20 bp, Artificial Sequence
  Description of Artificial Sequence: Synthetic oligonucleotide
ttacctccgttttgtggccc

SEQ ID NO: 3046 - DNA, 20 bp, Artificial Sequence
  Description of Artificial Sequence: Synthetic oligonucleotide
cggtggatgttgtctgtgtg

SEQ ID NO: 3047 - DNA, 20 bp, Artificial Sequence
  Description of Artificial Sequence: Synthetic oligonucleotide
ggcccattagtcagtctgtg

SEQ ID NO: 3048 - DNA, 20 bp, Artificial Sequence
  Description of Artificial Sequence: Synthetic oligonucleotide
cgtttcctctggttcgtttc

SEQ ID NO: 3049 - DNA, 20 bp, Artificial Sequence
  Description of Artificial Sequence: Synthetic oligonucleotide
tttggggttttccggtgccc

SEQ ID NO: 3050 - DNA, 20 bp, Artificial Sequence
  Description of Artificial Sequence: Synthetic oligonucleotide
gcgaatacagctcttggtgc

SEQ ID NO: 3051 - DNA, 20 bp, Artificial Sequence
  Description of Artificial Sequence: Synthetic oligonucleotide
tggtcgtgtgtacgtctggc

SEQ ID NO: 3052 - DNA, 20 bp, Artificial Sequence
  Description of Artificial Sequence: Synthetic oligonucleotide
acgtcctttctatggctgtg

SEQ ID NO: 3053 - DNA, 20 bp, Artificial Sequence
  Description of Artificial Sequence: Synthetic oligonucleotide
acgtggtgtaggggggagtc

SEQ ID NO: 3054 - DNA, 20 bp, Artificial Sequence
  Description of Artificial Sequence: Synthetic oligonucleotide
catgcaatgagtggcacctg

SEQ ID NO: 3055 - DNA, 19 bp, Artificial Sequence
  Description of Artificial Sequence: Synthetic oligonucleotide
agctggtaaactgtcgccg

SEQ ID NO: 3056 - DNA, 20 bp, Artificial Sequence
  Description of Artificial Sequence: Synthetic oligonucleotide
gtgtcgtactggcgttggtg

SEQ ID NO: 3057 - DNA, 20 bp, Artificial Sequence
  Description of Artificial Sequence: Synthetic oligonucleotide
tttgacgtgtgatgggtccg

SEQ ID NO: 3058 - DNA, 20 bp, Artificial Sequence
  Description of Artificial Sequence: Synthetic oligonucleotide
caaagtatagactgtggatg

SEQ ID NO: 3059 - DNA, 20 bp, Artificial Sequence
  Description of Artificial Sequence: Synthetic oligonucleotide
tttgaggggtgatgggtcgg

SEQ ID NO: 3060 - DNA, 20 bp, Artificial Sequence
  Description of Artificial Sequence: Synthetic oligonucleotide
tgggttctatcgaccgtgtg

SEQ ID NO: 3061 - DNA, 20 bp, Artificial Sequence
  Description of Artificial Sequence: Synthetic oligonucleotide
tttcgtgtccactcacccca

SEQ ID NO: 3062 - DNA, 20 bp, Artificial Sequence
  Description of Artificial Sequence: Synthetic oligonucleotide
tagtaaacctctcgtgtagc

SEQ ID NO: 3063 - DNA, 20 bp, Artificial Sequence
  Description of Artificial Sequence: Synthetic oligonucleotide
ttgggtgggggatgggaccg

SEQ ID NO: 3064 - DNA, 20 bp, Artificial Sequence
  Description of Artificial Sequence: Synthetic oligonucleotide
aaccgcacagtgaccagccc

SEQ ID NO: 3065 - DNA, 20 bp, Artificial Sequence
  Description of Artificial Sequence: Synthetic oligonucleotide
actcaaagtctcccgttctc

SEQ ID NO: 3066 - DNA, 20 bp, Artificial Sequence
  Description of Artificial Sequence: Synthetic oligonucleotide
gagaacaatggtgtgtttgc

SEQ ID NO: 3067 - DNA, 20 bp, Artificial Sequence
  Description of Artificial Sequence: Synthetic oligonucleotide
tttagggttaatgcggggtc

SEQ ID NO: 3068 - DNA, 20 bp, Artificial Sequence
  Description of Artificial Sequence: Synthetic oligonucleotide
tcatggcagcacccgagctg

SEQ ID NO: 3069 - DNA, 20 bp, Artificial Sequence
  Description of Artificial Sequence: Synthetic oligonucleotide
tttgaagggtgttgggtcag

SEQ ID NO: 3070 - DNA, 20 bp, Artificial Sequence
  Description of Artificial Sequence: Synthetic oligonucleotide
ttgggtgtagagaggtaccg

SEQ ID NO: 3071 - DNA, 20 bp, Artificial Sequence
  Description of Artificial Sequence: Synthetic oligonucleotide
gttctccggccgattgtggc

SEQ ID NO: 3072 - DNA, 20 bp, Artificial Sequence
  Description of Artificial Sequence: Synthetic oligonucleotide
cctggtaaccgataatgccc

SEQ ID NO: 3073 - DNA, 20 bp, Artificial Sequence
  Description of Artificial Sequence: Synthetic oligonucleotide
aaacgagcgaccgtcaccta

SEQ ID NO: 3074 - DNA, 20 bp, Artificial Sequence
  Description of Artificial Sequence: Synthetic oligonucleotide
taagtcttaccaatcgtgtg

SEQ ID NO: 3075 - DNA, 20 bp, Artificial Sequence
  Description of Artificial Sequence: Synthetic oligonucleotide
ctaagaacctaacgtccatg

SEQ ID NO: 3076 - DNA, 20 bp, Artificial Sequence
  Description of Artificial Sequence: Synthetic oligonucleotide
catacctcgtccagactgtg

SEQ ID NO: 3077 - DNA, 20 bp, Artificial Sequence
  Description of Artificial Sequence: Synthetic oligonucleotide
accacacactacgcgagctg

SEQ ID NO: 3078 - DNA, 20 bp, Artificial Sequence
  Description of Artificial Sequence: Synthetic oligonucleotide
tactgcgctgtactcgtccc

SEQ ID NO: 3079 - DNA, 20 bp, Artificial Sequence
  Description of Artificial Sequence: Synthetic oligonucleotide
cacaggagaagggaggttgc

SEQ ID NO: 3080 - DNA, 20 bp, Artificial Sequence
  Description of Artificial Sequence: Synthetic oligonucleotide
agccgatcttgccgtttgcc

SEQ ID NO: 3081 - DNA, 20 bp, Artificial Sequence
  Description of Artificial Sequence: Synthetic oligonucleotide
cattgacttccgttgccccc

SEQ ID NO: 3082 - DNA, 20 bp, Artificial Sequence
  Description of Artificial Sequence: Synthetic oligonucleotide
acgggtacttggtctgtgtg

SEQ ID NO: 3083 - DNA, 20 bp, Artificial Sequence
  Description of Artificial Sequence: Synthetic oligonucleotide
taactgtcgacaaccccgtc

SEQ ID NO: 3084 - DNA, 20 bp, Artificial Sequence
  Description of Artificial Sequence: Synthetic oligonucleotide
ttggaaggaggatgggtccg

SEQ ID NO: 3085 - DNA, 20 bp, Artificial Sequence
  Description of Artificial Sequence: Synthetic oligonucleotide
ttcgaaggatgatgggtccg

SEQ ID NO: 3086 - DNA, 20 bp, Artificial Sequence
  Description of Artificial Sequence: Synthetic oligonucleotide
tattaatgctaaagtgtccc

SEQ ID NO: 3087 - DNA, 20 bp, Artificial Sequence
  Description of Artificial Sequence: Synthetic oligonucleotide
gtgggtgtagggtgttaccg

SEQ ID NO: 3088 - DNA, 20 bp, Artificial Sequence
  Description of Artificial Sequence: Synthetic oligonucleotide
tgaaaaacacattgttgcat

SEQ ID NO: 3089 - DNA, 20 bp, Artificial Sequence
  Description of Artificial Sequence: Synthetic oligonucleotide
ttggttgtaggggggtaccg

SEQ ID NO: 3090 - DNA, 18 bp, Artificial Sequence
  Description of Artificial Sequence: Synthetic oligonucleotide
acgccgctattcactccc

SEQ ID NO: 3091 - DNA, 20 bp, Artificial Sequence
  Description of Artificial Sequence: Synthetic oligonucleotide
aaacaggcaaaaagcttgta

SEQ ID NO: 3092 - DNA, 20 bp, Artificial Sequence
  Description of Artificial Sequence: Synthetic oligonucleotide
tcatgtgagaacgatccccc

SEQ ID NO: 3093 - DNA, 20 bp, Artificial Sequence
  Description of Artificial Sequence: Synthetic oligonucleotide
cgacctctgagttgcgtgac

SEQ ID NO: 3094 - DNA, 20 bp, Artificial Sequence
  Description of Artificial Sequence: Synthetic oligonucleotide
tcttttctccctgccctctc

SEQ ID NO: 3095 - DNA, 20 bp, Artificial Sequence
  Description of Artificial Sequence: Synthetic oligonucleotide
accttcgcagctggtttcgc

SEQ ID NO: 3096 - DNA, 20 bp, Artificial Sequence
  Description of Artificial Sequence: Synthetic oligonucleotide
gtatacagaaatttgcccgt

SEQ ID NO: 3097 - DNA, 20 bp, Artificial Sequence
  Description of Artificial Sequence: Synthetic oligonucleotide
tccgccgagttttcccccta

SEQ ID NO: 3098 - DNA, 20 bp, Artificial Sequence
  Description of Artificial Sequence: Synthetic oligonucleotide
cgtaaaaagtcggtggtcgc

SEQ ID NO: 3099 - DNA, 20 bp, Artificial Sequence
  Description of Artificial Sequence: Synthetic oligonucleotide
ttcgtagggtgatgggtccg

SEQ ID NO: 3100 - DNA, 20 bp, Artificial Sequence
  Description of Artificial Sequence: Synthetic oligonucleotide
ccgtatcttctctgtccccc

SEQ ID NO: 3101 - DNA, 20 bp, Artificial Sequence
  Description of Artificial Sequence: Synthetic oligonucleotide
aatacagtctcttttcgccg

SEQ ID NO: 3102 - DNA, 20 bp, Artificial Sequence
  Description of Artificial Sequence: Synthetic oligonucleotide
caatcatcgcatgtctgggc

SEQ ID NO: 3103 - DNA, 20 bp, Artificial Sequence
  Description of Artificial Sequence: Synthetic oligonucleotide
tcccctaatttctgtcgccg

SEQ ID NO: 3104 - DNA, 20 bp, Artificial Sequence
  Description of Artificial Sequence: Synthetic oligonucleotide
cctggagagcatcgttggtg

SEQ ID NO: 3105 - DNA, 20 bp, Artificial Sequence
  Description of Artificial Sequence: Synthetic oligonucleotide
taccaattagttatgaccgc

SEQ ID NO: 3106 - DNA, 20 bp, Artificial Sequence
  Description of Artificial Sequence: Synthetic oligonucleotide
atctacactgaggtggtgta

SEQ ID NO: 3107 - DNA, 21 bp, Artificial Sequence
  Description of Artificial Sequence: Synthetic oligonucleotide
ttgcggtgtagggtggtaccg

SEQ ID NO: 3108 - DNA, 20 bp, Artificial Sequence
  Description of Artificial Sequence: Synthetic oligonucleotide
tcgttgggtcggtgctgcac

SEQ ID NO: 3109 - DNA, 20 bp, Artificial Sequence
  Description of Artificial Sequence: Synthetic oligonucleotide
attgctcttctctgccgcac

SEQ ID NO: 3110 - DNA, 20 bp, Artificial Sequence
  Description of Artificial Sequence: Synthetic oligonucleotide
tgacctgtgtcatgccccac

SEQ ID NO: 3111 - DNA, 20 bp, Artificial Sequence
  Description of Artificial Sequence: Synthetic oligonucleotide
ttgggtgtagtgaggtaccg

SEQ ID NO: 3112 - DNA, 20 bp, Artificial Sequence
  Description of Artificial Sequence: Synthetic oligonucleotide
taggtaacaaattacacctg

SEQ ID NO: 3113 - DNA, 20 bp, Artificial Sequence
  Description of Artificial Sequence: Synthetic oligonucleotide
tttgaagtgtgatggggccg

SEQ ID NO: 3114 - DNA, 20 bp, Artificial Sequence
  Description of Artificial Sequence: Synthetic oligonucleotide
tttggtggaggatgggaccg

SEQ ID NO: 3115 - DNA, 20 bp, Artificial Sequence
  Description of Artificial Sequence: Synthetic oligonucleotide
attcacgatctgtcgctgcc

SEQ ID NO: 3116 - DNA, 20 bp, Artificial Sequence
  Description of Artificial Sequence: Synthetic oligonucleotide
gtcctagttctgtccctcac

SEQ ID NO: 3117 - DNA, 20 bp, Artificial Sequence
  Description of Artificial Sequence: Synthetic oligonucleotide
caagggcgaaaccctatctg

SEQ ID NO: 3118 - DNA, 20 bp, Artificial Sequence
  Description of Artificial Sequence: Synthetic oligonucleotide
tttctatggatgattccgtg

SEQ ID NO: 3119 - DNA, 20 bp, Artificial Sequence
  Description of Artificial Sequence: Synthetic oligonucleotide
tttgcagggtgatggctccg

SEQ ID NO: 3120 - DNA, 20 bp, Artificial Sequence
  Description of Artificial Sequence: Synthetic oligonucleotide
tcgcttgcacaatttttggc

SEQ ID NO: 3121 - DNA, 20 bp, Artificial Sequence
  Description of Artificial Sequence: Synthetic oligonucleotide
ccactgtcactccctgtccg

SEQ ID NO: 3122 - DNA, 20 bp, Artificial Sequence
  Description of Artificial Sequence: Synthetic oligonucleotide
aaaaatctccttcaccggtg

SEQ ID NO: 3123 - DNA, 20 bp, Artificial Sequence
  Description of Artificial Sequence: Synthetic oligonucleotide
accagtaaccgtacgcgctg

SEQ ID NO: 3124 - DNA, 20 bp, Artificial Sequence
  Description of Artificial Sequence: Synthetic oligonucleotide
cctacgaccagtacgtgctg

SEQ ID NO: 3125 - DNA, 20 bp, Artificial Sequence
  Description of Artificial Sequence: Synthetic oligonucleotide
attgtctatgtttacatggc

SEQ ID NO: 3126 - DNA, 20 bp, Artificial Sequence
  Description of Artificial Sequence: Synthetic oligonucleotide
tgcgatacgacatttctccc

SEQ ID NO: 3127 - DNA, 20 bp, Artificial Sequence
  Description of Artificial Sequence: Synthetic oligonucleotide
ttgggtgtagagcggtaccg

SEQ ID NO: 3128 - DNA, 22 bp, Artificial Sequence
  Description of Artificial Sequence: Synthetic oligonucleotide
tttttgaagggtgatgggtcct

SEQ ID NO: 3129 - DNA, 20 bp, Artificial Sequence
  Description of Artificial Sequence: Synthetic oligonucleotide
ctatgacgatcatccctgcc

SEQ ID NO: 3130 - DNA, 20 bp, Artificial Sequence
  Description of Artificial Sequence: Synthetic oligonucleotide
ccgcacttataccaccgctg

SEQ ID NO: 3131 - DNA, 20 bp, Artificial Sequence
  Description of Artificial Sequence: Synthetic oligonucleotide
cgttaaagtaatgtgggcgc

SEQ ID NO: 3132 - DNA, 20 bp, Artificial Sequence
  Description of Artificial Sequence: Synthetic oligonucleotide
gaattgccttcctgtagccc

SEQ ID NO: 3133 - DNA, 20 bp, Artificial Sequence
  Description of Artificial Sequence: Synthetic oligonucleotide
tttgatggagggtgggaccg

SEQ ID NO: 3134 - DNA, 20 bp, Artificial Sequence
  Description of Artificial Sequence: Synthetic oligonucleotide
gtcttcaggcttatcgtccc

SEQ ID NO: 3135 - DNA, 20 bp, Artificial Sequence
  Description of Artificial Sequence: Synthetic oligonucleotide
acgaggtccaatggtttgcc

SEQ ID NO: 3136 - DNA, 19 bp, Artificial Sequence
  Description of Artificial Sequence: Synthetic oligonucleotide
ctattggtgaagggcggtg

SEQ ID NO: 3137 - DNA, 19 bp, Artificial Sequence
  Description of Artificial Sequence: Synthetic oligonucleotide
catcttcctgctccctggc

SEQ ID NO: 3138 - DNA, 20 bp, Artificial Sequence
  Description of Artificial Sequence: Synthetic oligonucleotide
tttcgttaattgtcgttgca

SEQ ID NO: 3139 - DNA, 20 bp, Artificial Sequence
  Description of Artificial Sequence: Synthetic oligonucleotide
gtatagacataggctctgtg

SEQ ID NO: 3140 - DNA, 20 bp, Artificial Sequence
  Description of Artificial Sequence: Synthetic oligonucleotide
aacggtgatggtccagtgtc

SEQ ID NO: 3141 - DNA, 19 bp, Artificial Sequence
  Description of Artificial Sequence: Synthetic oligonucleotide
tttgaagggtgatgggccc

SEQ ID NO: 3142 - DNA, 20 bp, Artificial Sequence
  Description of Artificial Sequence: Synthetic oligonucleotide
accgttaagctccccgttgc

SEQ ID NO: 3143 - DNA, 20 bp, Artificial Sequence
  Description of Artificial Sequence: Synthetic oligonucleotide
taaacatctgcatcaccccc

SEQ ID NO: 3144 - DNA, 20 bp, Artificial Sequence
  Description of Artificial Sequence: Synthetic oligonucleotide
tttgggagtagggtgttccg

SEQ ID NO: 3145 - DNA, 20 bp, Artificial Sequence
  Description of Artificial Sequence: Synthetic oligonucleotide
gttggtgtaggggggttccg

SEQ ID NO: 3146 - DNA, 20 bp, Artificial Sequence
  Description of Artificial Sequence: Synthetic oligonucleotide
atgcttggagtagggaggtg

SEQ ID NO: 3147 - DNA, 20 bp, Artificial Sequence
  Description of Artificial Sequence: Synthetic oligonucleotide
cataggagtagggtggtagc

SEQ ID NO: 3148 - DNA, 20 bp, Artificial Sequence
  Description of Artificial Sequence: Synthetic oligonucleotide
aaaggaggagttgggatctg

SEQ ID NO: 3149 - DNA, 20 bp, Artificial Sequence
  Description of Artificial Sequence: Synthetic oligonucleotide
cttatggagtagggtggtgc

SEQ ID NO: 3150 - DNA, 20 bp, Artificial Sequence
  Description of Artificial Sequence: Synthetic oligonucleotide
attcacttcttttcttgccg

SEQ ID NO: 3151 - DNA, 20 bp, Artificial Sequence
  Description of Artificial Sequence: Synthetic oligonucleotide
atttggaggaggaggttccg

SEQ ID NO: 3152 - DNA, 20 bp, Artificial Sequence
  Description of Artificial Sequence: Synthetic oligonucleotide
tttgtttttctctttttccg

SEQ ID NO: 3153 - DNA, 21 bp, Artificial Sequence
  Description of Artificial Sequence: Synthetic oligonucleotide
tttatttctttccacgttccg

SEQ ID NO: 3154 - DNA, 20 bp, Artificial Sequence
  Description of Artificial Sequence: Synthetic oligonucleotide
ttctttattttttccctccg

SEQ ID NO: 3155 - DNA, 20 bp, Artificial Sequence
  Description of Artificial Sequence: Synthetic oligonucleotide
ccttttactttttttctccg

SEQ ID NO: 3156 - DNA, 20 bp, Artificial Sequence
  Description of Artificial Sequence: Synthetic oligonucleotide
ttttattcttttccgctccg

SEQ ID NO: 3157 - DNA, 22 bp, Artificial Sequence
  Description of Artificial Sequence: Synthetic oligonucleotide
aattatgtgttttttgtgaccg

SEQ ID NO: 3158 - DNA, 20 bp, Artificial Sequence
  Description of Artificial Sequence: Synthetic oligonucleotide
atcttttctttcttctgccg

SEQ ID NO: 3159 - DNA, 20 bp, Artificial Sequence
  Description of Artificial Sequence: Synthetic oligonucleotide
cttatggagtagggaggtgc

SEQ ID NO: 3160 - DNA, 20 bp, Artificial Sequence
  Description of Artificial Sequence: Synthetic oligonucleotide
tcttttcatgtttctctccg

SEQ ID NO: 3161 - DNA, 20 bp, Artificial Sequence
  Description of Artificial Sequence: Synthetic oligonucleotide
tttttcttttcctttgtccg

SEQ ID NO: 3162 - DNA, 20 bp, Artificial Sequence
  Description of Artificial Sequence: Synthetic oligonucleotide
attactcttctcttttgccg

SEQ ID NO: 3163 - DNA, 20 bp, Artificial Sequence
  Description of Artificial Sequence: Synthetic oligonucleotide
tttgttttattttttgtccc

SEQ ID NO: 3164 - DNA, 20 bp, Artificial Sequence
  Description of Artificial Sequence: Synthetic oligonucleotide
aagggtgtagggtgttcccg

SEQ ID NO: 3165 - DNA, 20 bp, Artificial Sequence
  Description of Artificial Sequence: Synthetic oligonucleotide
atttcttttctctgttgccg

SEQ ID NO: 3166 - DNA, 20 bp, Artificial Sequence
  Description of Artificial Sequence: Synthetic oligonucleotide
attccttttctttttctccg

SEQ ID NO: 3167 - DNA, 20 bp, Artificial Sequence
  Description of Artificial Sequence: Synthetic oligonucleotide
ttattttcctttttctgccg

SEQ ID NO: 3168 - DNA, 20 bp, Artificial Sequence
  Description of Artificial Sequence: Synthetic oligonucleotide
attcttttctcttttcaccg

SEQ ID NO: 3169 - DNA, 20 bp, Artificial Sequence
  Description of Artificial Sequence: Synthetic oligonucleotide
tttgttaattcttgtttccg

SEQ ID NO: 3170 - DNA, 20 bp, Artificial Sequence
  Description of Artificial Sequence: Synthetic oligonucleotide
atttcttttcctttttaccg

SEQ ID NO: 3171 - DNA, 20 bp, Artificial Sequence
  Description of Artificial Sequence: Synthetic oligonucleotide
attctctttctttttcaccg

SEQ ID NO: 3172 - DNA, 20 bp, Artificial Sequence
  Description of Artificial Sequence: Synthetic oligonucleotide
atttctcttcttctttgccg

SEQ ID NO: 3173 - DNA, 20 bp, Artificial Sequence
  Description of Artificial Sequence: Synthetic oligonucleotide
tttgtttattcttttttccg

SEQ ID NO: 3174 - DNA, 20 bp, Artificial Sequence
  Description of Artificial Sequence: Synthetic oligonucleotide
atctttcttattttctgccg

SEQ ID NO: 3175 - DNA, 20 bp, Artificial Sequence
  Description of Artificial Sequence: Synthetic oligonucleotide
tctttttaactttttctccg

SEQ ID NO: 3176 - DNA, 20 bp, Artificial Sequence
  Description of Artificial Sequence: Synthetic oligonucleotide
actttcttctcttcttgccg

SEQ ID NO: 3177 - DNA, 21 bp, Artificial Sequence
  Description of Artificial Sequence: Synthetic oligonucleotide
ctttcactttttttctctccg

SEQ ID NO: 3178 - DNA, 20 bp, Artificial Sequence
  Description of Artificial Sequence: Synthetic oligonucleotide
attttctcttttgcttgccg

SEQ ID NO: 3179 - DNA, 20 bp, Artificial Sequence
  Description of Artificial Sequence: Synthetic oligonucleotide
taaggaggagttgggaaccg

SEQ ID NO: 3180 - DNA, 19 bp, Artificial Sequence
  Description of Artificial Sequence: Synthetic oligonucleotide
attcttgctttttttgccg

SEQ ID NO: 3181 - DNA, 20 bp, Artificial Sequence
  Description of Artificial Sequence: Synthetic oligonucleotide
tttttcattccctttttccg

SEQ ID NO: 3182 - DNA, 20 bp, Artificial Sequence
  Description of Artificial Sequence: Synthetic oligonucleotide
ttttcactctcttctctccg

SEQ ID NO: 3183 - DNA, 20 bp, Artificial Sequence
  Description of Artificial Sequence: Synthetic oligonucleotide
attttcttcttcttttaccg

SEQ ID NO: 3184 - DNA, 20 bp, Artificial Sequence
  Description of Artificial Sequence: Synthetic oligonucleotide
tctttactttctctttgccg

SEQ ID NO: 3185 - DNA, 20 bp, Artificial Sequence
  Description of Artificial Sequence: Synthetic oligonucleotide
tttcttgtctattttttccg

SEQ ID NO: 3186 - DNA, 20 bp, Artificial Sequence
  Description of Artificial Sequence: Synthetic oligonucleotide
attttctcttttttctgccg

SEQ ID NO: 3187 - DNA, 20 bp, Artificial Sequence
  Description of Artificial Sequence: Synthetic oligonucleotide
acttctcttgtcttcttccg

SEQ ID NO: 3188 - DNA, 20 bp, Artificial Sequence
  Description of Artificial Sequence: Synthetic oligonucleotide
tcttttgttattttcatccg

SEQ ID NO: 3189 - DNA, 20 bp, Artificial Sequence
  Description of Artificial Sequence: Synthetic oligonucleotide
cttttcttcgctttttaccg

SEQ ID NO: 3190 - DNA, 20 bp, Artificial Sequence
  Description of Artificial Sequence: Synthetic oligonucleotide
tttctctttttctctttccg

SEQ ID NO: 3191 - DNA, 21 bp, Artificial Sequence
  Description of Artificial Sequence: Synthetic oligonucleotide
ctttatttttgttttttgccc

SEQ ID NO: 3192 - DNA, 20 bp, Artificial Sequence
  Description of Artificial Sequence: Synthetic oligonucleotide
cttcttcacttttccctccg

SEQ ID NO: 3193 - DNA, 20 bp, Artificial Sequence
  Description of Artificial Sequence: Synthetic oligonucleotide
ctttttcttctcttgttccg

SEQ ID NO: 3194 - DNA, 20 bp, Artificial Sequence
  Description of Artificial Sequence: Synthetic oligonucleotide
attcttctattttctcaccg

SEQ ID NO: 3195 - DNA, 20 bp, Artificial Sequence
  Description of Artificial Sequence: Synthetic oligonucleotide
tcttatttttctcttctccg

SEQ ID NO: 3196 - DNA, 20 bp, Artificial Sequence
  Description of Artificial Sequence: Synthetic oligonucleotide
ttttgtcatttcttgttccg

SEQ ID NO: 3197 - DNA, 20 bp, Artificial Sequence
  Description of Artificial Sequence: Synthetic oligonucleotide
tttattttctcgttgttgtg

SEQ ID NO: 3198 - DNA, 20 bp, Artificial Sequence
  Description of Artificial Sequence: Synthetic oligonucleotide
atttttctctactttcaccg

SEQ ID NO: 3199 - DNA, 20 bp, Artificial Sequence
  Description of Artificial Sequence: Synthetic oligonucleotide
ttcattttcttttctctccg

SEQ ID NO: 3200 - DNA, 20 bp, Artificial Sequence
  Description of Artificial Sequence: Synthetic oligonucleotide
agaggtgtagggaggttccg

SEQ ID NO: 3201 - DNA, 20 bp, Artificial Sequence
  Description of Artificial Sequence: Synthetic oligonucleotide
ttttttatggtttgtttccg

SEQ ID NO: 3202 - DNA, 20 bp, Artificial Sequence
  Description of Artificial Sequence: Synthetic oligonucleotide
actttttttgtcttctgccg

SEQ ID NO: 3203 - DNA, 21 bp, Artificial Sequence
  Description of Artificial Sequence: Synthetic oligonucleotide
gttttcttgtttcttgttccg

SEQ ID NO: 3204 - DNA, 20 bp, Artificial Sequence
  Description of Artificial Sequence: Synthetic oligonucleotide
ctttttgctctttttctccg

SEQ ID NO: 3205 - DNA, 20 bp, Artificial Sequence
  Description of Artificial Sequence: Synthetic oligonucleotide
cttttctttctctttttccg

SEQ ID NO: 3206 - DNA, 20 bp, Artificial Sequence
  Description of Artificial Sequence: Synthetic oligonucleotide
atctttattttttctctccg

SEQ ID NO: 3207 - DNA, 20 bp, Artificial Sequence
  Description of Artificial Sequence: Synthetic oligonucleotide
ttcactttttcctcattccg

SEQ ID NO: 3208 - DNA, 20 bp, Artificial Sequence
  Description of Artificial Sequence: Synthetic oligonucleotide
actctttcttctctttgccg

SEQ ID NO: 3209 - DNA, 20 bp, Artificial Sequence
  Description of Artificial Sequence: Synthetic oligonucleotide
attccttttctcctttgccg

SEQ ID NO: 3210 - DNA, 19 bp, Artificial Sequence
  Description of Artificial Sequence: Synthetic oligonucleotide
tcctgtcgtctttcgtccc

SEQ ID NO: 3211 - DNA, 20 bp, Artificial Sequence
  Description of Artificial Sequence: Synthetic oligonucleotide
actttactcttcttttaccg

SEQ ID NO: 3212 - DNA, 20 bp, Artificial Sequence
  Description of Artificial Sequence: Synthetic oligonucleotide
cttctttaaatttccctccg

SEQ ID NO: 3213 - DNA, 20 bp, Artificial Sequence
  Description of Artificial Sequence: Synthetic oligonucleotide
tattttccttgttttctccg

SEQ ID NO: 3214 - DNA, 20 bp, Artificial Sequence
  Description of Artificial Sequence: Synthetic oligonucleotide
ttttctttctattctttccg

SEQ ID NO: 3215 - DNA, 20 bp, Artificial Sequence
  Description of Artificial Sequence: Synthetic oligonucleotide
tttttgttcccttttgcccg

SEQ ID NO: 3216 - DNA, 20 bp, Artificial Sequence
  Description of Artificial Sequence: Synthetic oligonucleotide
tgggtgtagggaggtaaccg

SEQ ID NO: 3217 - DNA, 20 bp, Artificial Sequence
  Description of Artificial Sequence: Synthetic oligonucleotide
acttttttctctcctttccg

SEQ ID NO: 3218 - DNA, 20 bp, Artificial Sequence
  Description of Artificial Sequence: Synthetic oligonucleotide
tttctttccatttcttgccg

SEQ ID NO: 3219 - DNA, 20 bp, Artificial Sequence
  Description of Artificial Sequence: Synthetic oligonucleotide
attatttactttttgccccg

SEQ ID NO: 3220 - DNA, 20 bp, Artificial Sequence
  Description of Artificial Sequence: Synthetic oligonucleotide
tttctttcgttttctctccg

SEQ ID NO: 3221 - DNA, 20 bp, Artificial Sequence
  Description of Artificial Sequence: Synthetic oligonucleotide
tcttttcttctcttctaccg

SEQ ID NO: 3222 - DNA, 20 bp, Artificial Sequence
  Description of Artificial Sequence: Synthetic oligonucleotide
tttcttttactttctttccg

SEQ ID NO: 3223 - DNA, 20 bp, Artificial Sequence
  Description of Artificial Sequence: Synthetic oligonucleotide
accttttctttcctattccg

SEQ ID NO: 3224 - DNA, 20 bp, Artificial Sequence
  Description of Artificial Sequence: Synthetic oligonucleotide
ttttattttcttttcccccg

SEQ ID NO: 3225 - DNA, 20 bp, Artificial Sequence
  Description of Artificial Sequence: Synthetic oligonucleotide
ttttttgattcttgtttccg

SEQ ID NO: 3226 - DNA, 20 bp, Artificial Sequence
  Description of Artificial Sequence: Synthetic oligonucleotide
tcctgtcggctgttcgtccc

SEQ ID NO: 3227 - DNA, 20 bp, Artificial Sequence
  Description of Artificial Sequence: Synthetic oligonucleotide
ttcatttcttctcttctccg

SEQ ID NO: 3228 - DNA, 20 bp, Artificial Sequence
  Description of Artificial Sequence: Synthetic oligonucleotide
tttgggagtagggtgttccc

SEQ ID NO: 3229 - DNA, 20 bp, Artificial Sequence
  Description of Artificial Sequence: Synthetic oligonucleotide
tttactttcctcttttgccg

SEQ ID NO: 3230 - DNA, 20 bp, Artificial Sequence
  Description of Artificial Sequence: Synthetic oligonucleotide
atctttctttactctcaccg

SEQ ID NO: 3231 - DNA, 20 bp, Artificial Sequence
  Description of Artificial Sequence: Synthetic oligonucleotide
tttttctactttcttttccg

SEQ ID NO: 3232 - DNA, 20 bp, Artificial Sequence
  Description of Artificial Sequence: Synthetic oligonucleotide
tttcttttgctttctctccg

SEQ ID NO: 3233 - DNA, 20 bp, Artificial Sequence
  Description of Artificial Sequence: Synthetic oligonucleotide
tctttttctacctttttccg

SEQ ID NO: 3234 - DNA, 19 bp, Artificial Sequence
  Description of Artificial Sequence: Synthetic oligonucleotide
ttgggagtagggtgttccg

SEQ ID NO: 3235 - DNA, 20 bp, Artificial Sequence
  Description of Artificial Sequence: Synthetic oligonucleotide
ttttactattctcctttccg

SEQ ID NO: 3236 - DNA, 20 bp, Artificial Sequence
  Description of Artificial Sequence: Synthetic oligonucleotide
attttttctttcctttgccg

SEQ ID NO: 3237 - DNA, 20 bp, Artificial Sequence
  Description of Artificial Sequence: Synthetic oligonucleotide
tattttcttctttttctccg

SEQ ID NO: 3238 - DNA, 19 bp, Artificial Sequence
  Description of Artificial Sequence: Synthetic oligonucleotide
tccgtcgtctgttcgtccc

SEQ ID NO: 3239 - DNA, 20 bp, Artificial Sequence
  Description of Artificial Sequence: Synthetic oligonucleotide
tctttttgtttctttatccg

SEQ ID NO: 3240 - DNA, 20 bp, Artificial Sequence
  Description of Artificial Sequence: Synthetic oligonucleotide
tttgattctctttgtttccg

SEQ ID NO: 3241 - DNA, 20 bp, Artificial Sequence
  Description of Artificial Sequence: Synthetic oligonucleotide
tcctgtcgtctggtcgtccc

SEQ ID NO: 3242 - DNA, 20 bp, Artificial Sequence
  Description of Artificial Sequence: Synthetic oligonucleotide
atttgttgttctttttaccg

SEQ ID NO: 3243 - DNA, 20 bp, Artificial Sequence
  Description of Artificial Sequence: Synthetic oligonucleotide
ttcttcatttctctctgccg

SEQ ID NO: 3244 - DNA, 20 bp, Artificial Sequence
  Description of Artificial Sequence: Synthetic oligonucleotide
tttcacttttccattctccg

SEQ ID NO: 3245 - DNA, 21 bp, Artificial Sequence
  Description of Artificial Sequence: Synthetic oligonucleotide
tccttgtcgtctgttcgtccc

SEQ ID NO: 3246 - DNA, 20 bp, Artificial Sequence
  Description of Artificial Sequence: Synthetic oligonucleotide
ttttaagtttttcgtttgtg

SEQ ID NO: 3247 - DNA, 20 bp, Artificial Sequence
  Description of Artificial Sequence: Synthetic oligonucleotide
ggttggaggtggtggatccg

SEQ ID NO: 3248 - DNA, 20 bp, Artificial Sequence
  Description of Artificial Sequence: Synthetic oligonucleotide
acattcttctctctttaccg

SEQ ID NO: 3249 - DNA, 20 bp, Artificial Sequence
  Description of Artificial Sequence: Synthetic oligonucleotide
attctcttttatccctaccg

SEQ ID NO: 3250 - DNA, 20 bp, Artificial Sequence
  Description of Artificial Sequence: Synthetic oligonucleotide
attttctttcctctttaccg

SEQ ID NO: 3251 - DNA, 20 bp, Artificial Sequence
  Description of Artificial Sequence: Synthetic oligonucleotide
tttttcataccttttttccg

SEQ ID NO: 3252 - DNA, 20 bp, Artificial Sequence
  Description of Artificial Sequence: Synthetic oligonucleotide
ttttcttttccacttttccg

SEQ ID NO: 3253 - DNA, 20 bp, Artificial Sequence
  Description of Artificial Sequence: Synthetic oligonucleotide
attatcttttctttgttccg

SEQ ID NO: 3254 - DNA, 20 bp, Artificial Sequence
  Description of Artificial Sequence: Synthetic oligonucleotide
tttcttacttttttcatccg

SEQ ID NO: 3255 - DNA, 20 bp, Artificial Sequence
  Description of Artificial Sequence: Synthetic oligonucleotide
tttcttctttcttctttccg

SEQ ID NO: 3256 - DNA, 20 bp, Artificial Sequence
  Description of Artificial Sequence: Synthetic oligonucleotide
tcctgtcgtctgttcgtacc

SEQ ID NO: 3257 - DNA, 20 bp, Artificial Sequence
  Description of Artificial Sequence: Synthetic oligonucleotide
tattgagagaggaggtggtg

SEQ ID NO: 3258 - DNA, 20 bp, Artificial Sequence
  Description of Artificial Sequence: Synthetic oligonucleotide
tttttgttatttttgctctg

SEQ ID NO: 3259 - DNA, 20 bp, Artificial Sequence
  Description of Artificial Sequence: Synthetic oligonucleotide
tttcttttcactcttatccg

SEQ ID NO: 3260 - DNA, 21 bp, Artificial Sequence
  Description of Artificial Sequence: Synthetic oligonucleotide
tcctgtcgtctgtttcgtccc

SEQ ID NO: 3261 - DNA, 20 bp, Artificial Sequence
  Description of Artificial Sequence: Synthetic oligonucleotide
atgttttctcttctttaccg

SEQ ID NO: 3262 - DNA, 20 bp, Artificial Sequence
  Description of Artificial Sequence: Synthetic oligonucleotide
tatgaaggggaggtggtccg

SEQ ID NO: 3263 - DNA, 20 bp, Artificial Sequence
  Description of Artificial Sequence: Synthetic oligonucleotide
ggtaggtgtagggaggtccc

SEQ ID NO: 3264 - DNA, 20 bp, Artificial Sequence
  Description of Artificial Sequence: Synthetic oligonucleotide
ttttattcactttttgtccc

SEQ ID NO: 3265 - DNA, 20 bp, Artificial Sequence
  Description of Artificial Sequence: Synthetic oligonucleotide
catcatgttttgctttcgtc

SEQ ID NO: 3266 - DNA, 21 bp, Artificial Sequence
  Description of Artificial Sequence: Synthetic oligonucleotide
cttttctcttcttgtttaccg

SEQ ID NO: 3267 - DNA, 20 bp, Artificial Sequence
  Description of Artificial Sequence: Synthetic oligonucleotide
tatttacttctttttgcccg

SEQ ID NO: 3268 - DNA, 20 bp, Artificial Sequence
  Description of Artificial Sequence: Synthetic oligonucleotide
tttttgttccattttatccg

SEQ ID NO: 3269 - DNA, 20 bp, Artificial Sequence
  Description of Artificial Sequence: Synthetic oligonucleotide
cttttcttcttttctttccg

SEQ ID NO: 3270 - DNA, 20 bp, Artificial Sequence
  Description of Artificial Sequence: Synthetic oligonucleotide
attttttcctgtttttgccg

SEQ ID NO: 3271 - DNA, 20 bp, Artificial Sequence
  Description of Artificial Sequence: Synthetic oligonucleotide
ctttttattacttttctccg

SEQ ID NO: 3272 - DNA, 20 bp, Artificial Sequence
  Description of Artificial Sequence: Synthetic oligonucleotide
tttttcttatgtttgctccg

SEQ ID NO: 3273 - DNA, 20 bp, Artificial Sequence
  Description of Artificial Sequence: Synthetic oligonucleotide
cctttttctttccttttccg

SEQ ID NO: 3274 - DNA, 20 bp, Artificial Sequence
  Description of Artificial Sequence: Synthetic oligonucleotide
tttatattttgtttcctgtg

SEQ ID NO: 3275 - DNA, 20 bp, Artificial Sequence
  Description of Artificial Sequence: Synthetic oligonucleotide
cttcttttctcgcttttccg

SEQ ID NO: 3276 - DNA, 20 bp, Artificial Sequence
  Description of Artificial Sequence: Synthetic oligonucleotide
atttctcttctattttaccg

SEQ ID NO: 3277 - DNA, 20 bp, Artificial Sequence
  Description of Artificial Sequence: Synthetic oligonucleotide
ttctttctttcccttttccg

SEQ ID NO: 3278 - DNA, 20 bp, Artificial Sequence
  Description of Artificial Sequence: Synthetic oligonucleotide
ttttcttgcccttttttccg

SEQ ID NO: 3279 - DNA, 20 bp, Artificial Sequence
  Description of Artificial Sequence: Synthetic oligonucleotide
tttttctgtcttttgctccg

SEQ ID NO: 3280 - DNA, 20 bp, Artificial Sequence
  Description of Artificial Sequence: Synthetic oligonucleotide
gatggtggtgtagggtactg

SEQ ID NO: 3281 - DNA, 22 bp, Artificial Sequence
  Description of Artificial Sequence: Synthetic oligonucleotide
ttttagcttctttttttgtccg

SEQ ID NO: 3282 - DNA, 20 bp, Artificial Sequence
  Description of Artificial Sequence: Synthetic oligonucleotide
ttttcactattctctctccg

SEQ ID NO: 3283 - DNA, 20 bp, Artificial Sequence
  Description of Artificial Sequence: Synthetic oligonucleotide
ccacttatttcctttttccg

SEQ ID NO: 3284 - DNA, 20 bp, Artificial Sequence
  Description of Artificial Sequence: Synthetic oligonucleotide
ttctttcttcttttcctccg

SEQ ID NO: 3285 - DNA, 20 bp, Artificial Sequence
  Description of Artificial Sequence: Synthetic oligonucleotide
ttttatcttactttttgctg

SEQ ID NO: 3286 - DNA, 20 bp, Artificial Sequence
  Description of Artificial Sequence: Synthetic oligonucleotide
aactactttttctctctccg

SEQ ID NO: 3287 - DNA, 20 bp, Artificial Sequence
  Description of Artificial Sequence: Synthetic oligonucleotide
ttcttttcttattctttccg

SEQ ID NO: 3288 - DNA, 21 bp, Artificial Sequence
  Description of Artificial Sequence: Synthetic oligonucleotide
tcctgtcgtctgttcgtcccc

SEQ ID NO: 3289 - DNA, 20 bp, Artificial Sequence
  Description of Artificial Sequence: Synthetic oligonucleotide
cttttcatttctctttaccg

SEQ ID NO: 3290 - DNA, 21 bp, Artificial Sequence
  Description of Artificial Sequence: Synthetic oligonucleotide
tttattttcttctcatttccg

SEQ ID NO: 3291 - DNA, 20 bp, Artificial Sequence
  Description of Artificial Sequence: Synthetic oligonucleotide
attctgttttcttgttaccg

SEQ ID NO: 3292 - DNA, 18 bp, Artificial Sequence
  Description of Artificial Sequence: Synthetic oligonucleotide
tttcttgtttcttttccg

SEQ ID NO: 3293 - DNA, 20 bp, Artificial Sequence
  Description of Artificial Sequence: Synthetic oligonucleotide
tttttccttttgccgttccg

SEQ ID NO: 3294 - DNA, 20 bp, Artificial Sequence
  Description of Artificial Sequence: Synthetic oligonucleotide
ttctttatcctttttctccg

SEQ ID NO: 3295 - DNA, 20 bp, Artificial Sequence
  Description of Artificial Sequence: Synthetic oligonucleotide
tcctgtcgtctgttcgtcct

SEQ ID NO: 3296 - DNA, 20 bp, Artificial Sequence
  Description of Artificial Sequence: Synthetic oligonucleotide
tttattcttttctttgcccc

SEQ ID NO: 3297 - DNA, 20 bp, Artificial Sequence
  Description of Artificial Sequence: Synthetic oligonucleotide
tcctgtcgactgttcgtccc

SEQ ID NO: 3298 - DNA, 20 bp, Artificial Sequence
  Description of Artificial Sequence: Synthetic oligonucleotide
ctcatttcttctcttttccg

SEQ ID NO: 3299 - DNA, 20 bp, Artificial Sequence
  Description of Artificial Sequence: Synthetic oligonucleotide
cttttactgttcttttaccg

SEQ ID NO: 3300 - DNA, 20 bp, Artificial Sequence
  Description of Artificial Sequence: Synthetic oligonucleotide
tttttgtcttgttttttccg

SEQ ID NO: 3301 - DNA, 20 bp, Artificial Sequence
  Description of Artificial Sequence: Synthetic oligonucleotide
ttttctattattcttttccg

SEQ ID NO: 3302 - DNA, 20 bp, Artificial Sequence
  Description of Artificial Sequence: Synthetic oligonucleotide
tctttcacttactttttccg

SEQ ID NO: 3303 - DNA, 20 bp, Artificial Sequence
  Description of Artificial Sequence: Synthetic oligonucleotide
ttttctaggctttttttccg

SEQ ID NO: 3304 - DNA, 20 bp, Artificial Sequence
  Description of Artificial Sequence: Synthetic oligonucleotide
ttccacttcttttctttccg

SEQ ID NO: 3305 - DNA, 20 bp, Artificial Sequence
  Description of Artificial Sequence: Synthetic oligonucleotide
tttttgttttgtttttggtg

SEQ ID NO: 3306 - DNA, 20 bp, Artificial Sequence
  Description of Artificial Sequence: Synthetic oligonucleotide
attttactctcattttaccg

SEQ ID NO: 3307 - DNA, 19 bp, Artificial Sequence
  Description of Artificial Sequence: Synthetic oligonucleotide
tcttttgctttcttttccg

SEQ ID NO: 3308 - DNA, 20 bp, Artificial Sequence
  Description of Artificial Sequence: Synthetic oligonucleotide
ttttcatttacttcgctccg

SEQ ID NO: 3309 - DNA, 20 bp, Artificial Sequence
  Description of Artificial Sequence: Synthetic oligonucleotide
cctttaattatttctctccg

SEQ ID NO: 3310 - DNA, 20 bp, Artificial Sequence
  Description of Artificial Sequence: Synthetic oligonucleotide
tttactcttttcactttccc

SEQ ID NO: 3311 - DNA, 20 bp, Artificial Sequence
  Description of Artificial Sequence: Synthetic oligonucleotide
attttccctttcttttgccg

SEQ ID NO: 3312 - DNA, 20 bp, Artificial Sequence
  Description of Artificial Sequence: Synthetic oligonucleotide
ttcttttctttctttctccg

SEQ ID NO: 3313 - DNA, 20 bp, Artificial Sequence
  Description of Artificial Sequence: Synthetic oligonucleotide
agaggcgtagggaggttccg

SEQ ID NO: 3314 - DNA, 20 bp, Artificial Sequence
  Description of Artificial Sequence: Synthetic oligonucleotide
accttttctctctctatccg

SEQ ID NO: 3315 - DNA, 21 bp, Artificial Sequence
  Description of Artificial Sequence: Synthetic oligonucleotide
tctttttttgtttttctgccg

SEQ ID NO: 3316 - DNA, 20 bp, Artificial Sequence
  Description of Artificial Sequence: Synthetic oligonucleotide
cttttcactcgctttttccg

SEQ ID NO: 3317 - DNA, 20 bp, Artificial Sequence
  Description of Artificial Sequence: Synthetic oligonucleotide
ttattttatttcctttgccc

SEQ ID NO: 3318 - DNA, 20 bp, Artificial Sequence
  Description of Artificial Sequence: Synthetic oligonucleotide
tcctgtcgtctgtgcgtccc

SEQ ID NO: 3319 - DNA, 20 bp, Artificial Sequence
  Description of Artificial Sequence: Synthetic oligonucleotide
atttttgtattcttttgccc

SEQ ID NO: 3320 - DNA, 20 bp, Artificial Sequence
  Description of Artificial Sequence: Synthetic oligonucleotide
atctatttattttctcaccg

SEQ ID NO: 3321 - DNA, 20 bp, Artificial Sequence
  Description of Artificial Sequence: Synthetic oligonucleotide
ttttctttccttatttgccg

SEQ ID NO: 3322 - DNA, 20 bp, Artificial Sequence
  Description of Artificial Sequence: Synthetic oligonucleotide
tttttctcaagctttttccg

SEQ ID NO: 3323 - DNA, 20 bp, Artificial Sequence
  Description of Artificial Sequence: Synthetic oligonucleotide
cttctttttctttctttccg

SEQ ID NO: 3324 - DNA, 20 bp, Artificial Sequence
  Description of Artificial Sequence: Synthetic oligonucleotide
ctttacctttttcttttccg

SEQ ID NO: 3325 - DNA, 20 bp, Artificial Sequence
  Description of Artificial Sequence: Synthetic oligonucleotide
tacttttctttttttctccg

SEQ ID NO: 3326 - DNA, 20 bp, Artificial Sequence
  Description of Artificial Sequence: Synthetic oligonucleotide
tttcttatttccgttttccg

SEQ ID NO: 3327 - DNA, 20 bp, Artificial Sequence
  Description of Artificial Sequence: Synthetic oligonucleotide
ctctttcttctttttctccg

SEQ ID NO: 3328 - DNA, 20 bp, Artificial Sequence
  Description of Artificial Sequence: Synthetic oligonucleotide
cctttttattccttttgccg

SEQ ID NO: 3329 - DNA, 20 bp, Artificial Sequence
  Description of Artificial Sequence: Synthetic oligonucleotide
ccttttattattcccttccg

SEQ ID NO: 3330 - DNA, 19 bp, Artificial Sequence
  Description of Artificial Sequence: Synthetic oligonucleotide
ttattctctctttcttccg

SEQ ID NO: 3331 - DNA, 20 bp, Artificial Sequence
  Description of Artificial Sequence: Synthetic oligonucleotide
tctttttatttgcttttccg

SEQ ID NO: 3332 - DNA, 20 bp, Artificial Sequence
  Description of Artificial Sequence: Synthetic oligonucleotide
ttttacacttttcccctccg

SEQ ID NO: 3333 - DNA, 20 bp, Artificial Sequence
  Description of Artificial Sequence: Synthetic oligonucleotide
atttttgtcttttgttactg

SEQ ID NO: 3334 - DNA, 20 bp, Artificial Sequence
  Description of Artificial Sequence: Synthetic oligonucleotide
ttttgtttcacttttgtctg

SEQ ID NO: 3335 - DNA, 20 bp, Artificial Sequence
  Description of Artificial Sequence: Synthetic oligonucleotide
tctctttttccttatctccg

SEQ ID NO: 3336 - DNA, 20 bp, Artificial Sequence
  Description of Artificial Sequence: Synthetic oligonucleotide
atattttgtttttcttgccc

SEQ ID NO: 3337 - DNA, 20 bp, Artificial Sequence
  Description of Artificial Sequence: Synthetic oligonucleotide
attatttactctttctaccg

SEQ ID NO: 3338 - DNA, 20 bp, Artificial Sequence
  Description of Artificial Sequence: Synthetic oligonucleotide
atctttaatttctcttgccg

SEQ ID NO: 3339 - DNA, 20 bp, Artificial Sequence
  Description of Artificial Sequence: Synthetic oligonucleotide
cttttattcttgctctaccg

SEQ ID NO: 3340 - DNA, 20 bp, Artificial Sequence
  Description of Artificial Sequence: Synthetic oligonucleotide
cttttttctctcttttaccg

SEQ ID NO: 3341 - DNA, 20 bp, Artificial Sequence
  Description of Artificial Sequence: Synthetic oligonucleotide
cttttcctttttttgttccg

SEQ ID NO: 3342 - DNA, 21 bp, Artificial Sequence
  Description of Artificial Sequence: Synthetic oligonucleotide
tttttcacttttttcgccccg

SEQ ID NO: 3343 - DNA, 20 bp, Artificial Sequence
  Description of Artificial Sequence: Synthetic oligonucleotide
tttttctactcttttttccg

SEQ ID NO: 3344 - DNA, 20 bp, Artificial Sequence
  Description of Artificial Sequence: Synthetic oligonucleotide
tcctgtcctctgttcgtccc

SEQ ID NO: 3345 - DNA, 20 bp, Artificial Sequence
  Description of Artificial Sequence: Synthetic oligonucleotide
tcctgtcgtatgttcgtccc

SEQ ID NO: 3346 - DNA, 20 bp, Artificial Sequence
  Description of Artificial Sequence: Synthetic oligonucleotide
acttttctttccattcaccg

SEQ ID NO: 3347 - DNA, 20 bp, Artificial Sequence
  Description of Artificial Sequence: Synthetic oligonucleotide
gttgtttcactctttttccg

SEQ ID NO: 3348 - DNA, 20 bp, Artificial Sequence
  Description of Artificial Sequence: Synthetic oligonucleotide
atttacatttctttttgccc

SEQ ID NO: 3349 - DNA, 20 bp, Artificial Sequence
  Description of Artificial Sequence: Synthetic oligonucleotide
tcttttacattccctttccg

SEQ ID NO: 3350 - DNA, 20 bp, Artificial Sequence
  Description of Artificial Sequence: Synthetic oligonucleotide
atctttatctcttttccccg

SEQ ID NO: 3351 - DNA, 20 bp, Artificial Sequence
  Description of Artificial Sequence: Synthetic oligonucleotide
ttctttgtactttccctccg

SEQ ID NO: 3352 - DNA, 20 bp, Artificial Sequence
  Description of Artificial Sequence: Synthetic oligonucleotide
gtttattcatcccttttccg

SEQ ID NO: 3353 - DNA, 20 bp, Artificial Sequence
  Description of Artificial Sequence: Synthetic oligonucleotide
atttttcgcctattttaccg

SEQ ID NO: 3354 - DNA, 20 bp, Artificial Sequence
  Description of Artificial Sequence: Synthetic oligonucleotide
gcttttccttctttttcccg

SEQ ID NO: 3355 - DNA, 20 bp, Artificial Sequence
  Description of Artificial Sequence: Synthetic oligonucleotide
attcttgcttttttttgccg

SEQ ID NO: 3356 - DNA, 20 bp, Artificial Sequence
  Description of Artificial Sequence: Synthetic oligonucleotide
tttttgtcacgttttctccg

SEQ ID NO: 3357 - DNA, 20 bp, Artificial Sequence
  Description of Artificial Sequence: Synthetic oligonucleotide
ttttgttcttttttcttccg

SEQ ID NO: 3358 - DNA, 20 bp, Artificial Sequence
  Description of Artificial Sequence: Synthetic oligonucleotide
cttttattcacttttttccg

SEQ ID NO: 3359 - DNA, 20 bp, Artificial Sequence
  Description of Artificial Sequence: Synthetic oligonucleotide
ttatttttttgtttgttgtg

SEQ ID NO: 3360 - DNA, 20 bp, Artificial Sequence
  Description of Artificial Sequence: Synthetic oligonucleotide
ctttcttgtttcttctaccg

SEQ ID NO: 3361 - DNA, 20 bp, Artificial Sequence
  Description of Artificial Sequence: Synthetic oligonucleotide
ttttcattatttactttccg

SEQ ID NO: 3362 - DNA, 20 bp, Artificial Sequence
  Description of Artificial Sequence: Synthetic oligonucleotide
attttatttcccttttaccg

SEQ ID NO: 3363 - DNA, 20 bp, Artificial Sequence
  Description of Artificial Sequence: Synthetic oligonucleotide
tttttgttaatttgtccctg

SEQ ID NO: 3364 - DNA, 20 bp, Artificial Sequence
  Description of Artificial Sequence: Synthetic oligonucleotide
ttttatctttcttttttccc

SEQ ID NO: 3365 - DNA, 20 bp, Artificial Sequence
  Description of Artificial Sequence: Synthetic oligonucleotide
gtttgctcttttttctgccg

SEQ ID NO: 3366 - DNA, 20 bp, Artificial Sequence
  Description of Artificial Sequence: Synthetic oligonucleotide
tcattacttcttttcatccg

SEQ ID NO: 3367 - DNA, 20 bp, Artificial Sequence
  Description of Artificial Sequence: Synthetic oligonucleotide
tccggtcgtctgttcgtccc

SEQ ID NO: 3368 - DNA, 20 bp, Artificial Sequence
  Description of Artificial Sequence: Synthetic oligonucleotide
attttcatttttttccgccg

SEQ ID NO: 3369 - DNA, 20 bp, Artificial Sequence
  Description of Artificial Sequence: Synthetic oligonucleotide
ctttttttatttcccttccg

SEQ ID NO: 3370 - DNA, 20 bp, Artificial Sequence
  Description of Artificial Sequence: Synthetic oligonucleotide
acttctatccttcttttccg

SEQ ID NO: 3371 - DNA, 20 bp, Artificial Sequence
  Description of Artificial Sequence: Synthetic oligonucleotide
tcttttcgttttcttctccg

SEQ ID NO: 3372 - DNA, 20 bp, Artificial Sequence
  Description of Artificial Sequence: Synthetic oligonucleotide
ccgtttatttcctttttccg

SEQ ID NO: 3373 - DNA, 21 bp, Artificial Sequence
  Description of Artificial Sequence: Synthetic oligonucleotide
tatttattttttcttgccccg

SEQ ID NO: 3374 - DNA, 20 bp, Artificial Sequence
  Description of Artificial Sequence: Synthetic oligonucleotide
ttttctcactcttttctccg

SEQ ID NO: 3375 - DNA, 20 bp, Artificial Sequence
  Description of Artificial Sequence: Synthetic oligonucleotide
atttcttattcctttccccg

SEQ ID NO: 3376 - DNA, 20 bp, Artificial Sequence
  Description of Artificial Sequence: Synthetic oligonucleotide
ttattttcactgtttttgcc

SEQ ID NO: 3377 - DNA, 22 bp, Artificial Sequence
  Description of Artificial Sequence: Synthetic oligonucleotide
tttttcactttttcttctgcgc

SEQ ID NO: 3378 - DNA, 21 bp, Artificial Sequence
  Description of Artificial Sequence: Synthetic oligonucleotide
ttttttattttcctggttccg

SEQ ID NO: 3379 - DNA, 20 bp, Artificial Sequence
  Description of Artificial Sequence: Synthetic oligonucleotide
tctatttcttgctttttccg

SEQ ID NO: 3380 - DNA, 21 bp, Artificial Sequence
  Description of Artificial Sequence: Synthetic oligonucleotide
ttctttatttttttccctccg

SEQ ID NO: 3381 - DNA, 20 bp, Artificial Sequence
  Description of Artificial Sequence: Synthetic oligonucleotide
tcgtttatttcttttttccg

SEQ ID NO: 3382 - DNA, 19 bp, Artificial Sequence
  Description of Artificial Sequence: Synthetic oligonucleotide
tcctgtcgtcttacgtccc

SEQ ID NO: 3383 - DNA, 20 bp, Artificial Sequence
  Description of Artificial Sequence: Synthetic oligonucleotide
atctttcttctctattaccg

SEQ ID NO: 3384 - DNA, 20 bp, Artificial Sequence
  Description of Artificial Sequence: Synthetic oligonucleotide
atttgttatgttttgtaccg

SEQ ID NO: 3385 - DNA, 20 bp, Artificial Sequence
  Description of Artificial Sequence: Synthetic oligonucleotide
tttttgtttttatttttccg

SEQ ID NO: 3386 - DNA, 20 bp, Artificial Sequence
  Description of Artificial Sequence: Synthetic oligonucleotide
ttttttcctcgcttttgccg

SEQ ID NO: 3387 - DNA, 20 bp, Artificial Sequence
  Description of Artificial Sequence: Synthetic oligonucleotide
ttcgctttctcttttatccg

SEQ ID NO: 3388 - DNA, 20 bp, Artificial Sequence
  Description of Artificial Sequence: Synthetic oligonucleotide
tttcttgatccttttttccg

SEQ ID NO: 3389 - DNA, 20 bp, Artificial Sequence
  Description of Artificial Sequence: Synthetic oligonucleotide
attttctcactctcttaccg

SEQ ID NO: 3390 - DNA, 19 bp, Artificial Sequence
  Description of Artificial Sequence: Synthetic oligonucleotide
tttttcttattcttttccg

SEQ ID NO: 3391 - DNA, 19 bp, Artificial Sequence
  Description of Artificial Sequence: Synthetic oligonucleotide
tcctgtcgtctgttccccc

SEQ ID NO: 3392 - DNA, 20 bp, Artificial Sequence
  Description of Artificial Sequence: Synthetic oligonucleotide
atttatcttctttttccccg

SEQ ID NO: 3393 - DNA, 20 bp, Artificial Sequence
  Description of Artificial Sequence: Synthetic oligonucleotide
ctttttcttcattttttccg

SEQ ID NO: 3394 - DNA, 20 bp, Artificial Sequence
  Description of Artificial Sequence: Synthetic oligonucleotide
cttactttttacttcctccg

SEQ ID NO: 3395 - DNA, 20 bp, Artificial Sequence
  Description of Artificial Sequence: Synthetic oligonucleotide
ttttcaattatttctgtccg

SEQ ID NO: 3396 - DNA, 20 bp, Artificial Sequence
  Description of Artificial Sequence: Synthetic oligonucleotide
tttctcttcttttctatccg

SEQ ID NO: 3397 - DNA, 20 bp, Artificial Sequence
  Description of Artificial Sequence: Synthetic oligonucleotide
atcttttcgcttttttaccg

SEQ ID NO: 3398 - DNA, 20 bp, Artificial Sequence
  Description of Artificial Sequence: Synthetic oligonucleotide
tcctgtcgtcggttcgtccc

SEQ ID NO: 3399 - DNA, 20 bp, Artificial Sequence
  Description of Artificial Sequence: Synthetic oligonucleotide
tctcatcttctttttctccg

SEQ ID NO: 3400 - DNA, 20 bp, Artificial Sequence
  Description of Artificial Sequence: Synthetic oligonucleotide
ttcttgctttattttttccg

SEQ ID NO: 3401 - DNA, 20 bp, Artificial Sequence
  Description of Artificial Sequence: Synthetic oligonucleotide
attttattgtttttttaccg

SEQ ID NO: 3402 - DNA, 21 bp, Artificial Sequence
  Description of Artificial Sequence: Synthetic oligonucleotide
tttttaccctttttttgtccg

SEQ ID NO: 3403 - DNA, 20 bp, Artificial Sequence
  Description of Artificial Sequence: Synthetic oligonucleotide
ttttttcagatttgtttccg

SEQ ID NO: 3404 - DNA, 21 bp, Artificial Sequence
  Description of Artificial Sequence: Synthetic oligonucleotide
tctcttctttctttatcgccg

SEQ ID NO: 3405 - DNA, 20 bp, Artificial Sequence
  Description of Artificial Sequence: Synthetic oligonucleotide
cttttctttttccctatccg

SEQ ID NO: 3406 - DNA, 20 bp, Artificial Sequence
  Description of Artificial Sequence: Synthetic oligonucleotide
ccattcacttttcttttccg

SEQ ID NO: 3407 - DNA, 20 bp, Artificial Sequence
  Description of Artificial Sequence: Synthetic oligonucleotide
ttttctcttttccatttccg

SEQ ID NO: 3408 - DNA, 20 bp, Artificial Sequence
  Description of Artificial Sequence: Synthetic oligonucleotide
cttttctcttttttccgcgc

SEQ ID NO: 3409 - DNA, 20 bp, Artificial Sequence
  Description of Artificial Sequence: Synthetic oligonucleotide
tttgtattcccctttttccg

SEQ ID NO: 3410 - DNA, 20 bp, Artificial Sequence
  Description of Artificial Sequence: Synthetic oligonucleotide
tctctttattttttcttccg

SEQ ID NO: 3411 - DNA, 21 bp, Artificial Sequence
  Description of Artificial Sequence: Synthetic oligonucleotide
attctcttttttttcccaccg

SEQ ID NO: 3412 - DNA, 20 bp, Artificial Sequence
  Description of Artificial Sequence: Synthetic oligonucleotide
ctttctactctcttcttccg

SEQ ID NO: 3413 - DNA, 20 bp, Artificial Sequence
  Description of Artificial Sequence: Synthetic oligonucleotide
gttgggagtagggtgttccg

SEQ ID NO: 3414 - DNA, 20 bp, Artificial Sequence
  Description of Artificial Sequence: Synthetic oligonucleotide
ttttattattacctgttccg

SEQ ID NO: 3415 - DNA, 20 bp, Artificial Sequence
  Description of Artificial Sequence: Synthetic oligonucleotide
attttctcatccttttgccg

SEQ ID NO: 3416 - DNA, 20 bp, Artificial Sequence
  Description of Artificial Sequence: Synthetic oligonucleotide
tacattcttttttctctccg

SEQ ID NO: 3417 - DNA, 19 bp, Artificial Sequence
  Description of Artificial Sequence: Synthetic oligonucleotide
tttgggagtagggtgtccg

SEQ ID NO: 3418 - DNA, 20 bp, Artificial Sequence
  Description of Artificial Sequence: Synthetic oligonucleotide
ttcatttacattcttttccg

SEQ ID NO: 3419 - DNA, 20 bp, Artificial Sequence
  Description of Artificial Sequence: Synthetic oligonucleotide
actttcactattttttaccg

SEQ ID NO: 3420 - DNA, 20 bp, Artificial Sequence
  Description of Artificial Sequence: Synthetic oligonucleotide
atcatgtcttcttttctccg

SEQ ID NO: 3421 - DNA, 21 bp, Artificial Sequence
  Description of Artificial Sequence: Synthetic oligonucleotide
aactacttttttctctctccg

SEQ ID NO: 3422 - DNA, 20 bp, Artificial Sequence
  Description of Artificial Sequence: Synthetic oligonucleotide
tttcctttttttcccatccg

SEQ ID NO: 3423 - DNA, 20 bp, Artificial Sequence
  Description of Artificial Sequence: Synthetic oligonucleotide
tttcttactcttcatttccg

SEQ ID NO: 3424 - DNA, 20 bp, Artificial Sequence
  Description of Artificial Sequence: Synthetic oligonucleotide
tcttcattctattttctccg

SEQ ID NO: 3425 - DNA, 20 bp, Artificial Sequence
  Description of Artificial Sequence: Synthetic oligonucleotide
ttttcttaatcccttttccg

SEQ ID NO: 3426 - DNA, 20 bp, Artificial Sequence
  Description of Artificial Sequence: Synthetic oligonucleotide
attgttttattgttttaccg

SEQ ID NO: 3427 - DNA, 20 bp, Artificial Sequence
  Description of Artificial Sequence: Synthetic oligonucleotide
gatttctattttctccaccc

SEQ ID NO: 3428 - DNA, 20 bp, Artificial Sequence
  Description of Artificial Sequence: Synthetic oligonucleotide
atttttgttcttgtctaccg

SEQ ID NO: 3429 - DNA, 20 bp, Artificial Sequence
  Description of Artificial Sequence: Synthetic oligonucleotide
cttttattttaccttctccg

SEQ ID NO: 3430 - DNA, 20 bp, Artificial Sequence
  Description of Artificial Sequence: Synthetic oligonucleotide
tttttcattttaccgttccg

SEQ ID NO: 3431 - DNA, 20 bp, Artificial Sequence
  Description of Artificial Sequence: Synthetic oligonucleotide
tttttctcttttttccgccg

SEQ ID NO: 3432 - DNA, 20 bp, Artificial Sequence
  Description of Artificial Sequence: Synthetic oligonucleotide
tctcttacaattttcttccg

SEQ ID NO: 3433 - DNA, 20 bp, Artificial Sequence
  Description of Artificial Sequence: Synthetic oligonucleotide
tgtttctcttactttttccg

SEQ ID NO: 3434 - DNA, 20 bp, Artificial Sequence
  Description of Artificial Sequence: Synthetic oligonucleotide
tcttttatcaattctctccg

SEQ ID NO: 3435 - DNA, 21 bp, Artificial Sequence
  Description of Artificial Sequence: Synthetic oligonucleotide
aattatgtgtttttgtgaccg

SEQ ID NO: 3436 - DNA, 20 bp, Artificial Sequence
  Description of Artificial Sequence: Synthetic oligonucleotide
tcggtggtgtggggattccg

SEQ ID NO: 3437 - DNA, 20 bp, Artificial Sequence
  Description of Artificial Sequence: Synthetic oligonucleotide
acctgtcgtctgttcgtccc

SEQ ID NO: 3438 - DNA, 20 bp, Artificial Sequence
  Description of Artificial Sequence: Synthetic oligonucleotide
actttattctcttttttccg

SEQ ID NO: 3439 - DNA, 20 bp, Artificial Sequence
  Description of Artificial Sequence: Synthetic oligonucleotide
ttatttgtttattttctccg

SEQ ID NO: 3440 - DNA, 20 bp, Artificial Sequence
  Description of Artificial Sequence: Synthetic oligonucleotide
tttatttatttttccgtccc

SEQ ID NO: 3441 - DNA, 20 bp, Artificial Sequence
  Description of Artificial Sequence: Synthetic oligonucleotide
ttctttttactttccttccg

SEQ ID NO: 3442 - DNA, 20 bp, Artificial Sequence
  Description of Artificial Sequence: Synthetic oligonucleotide
tatttttccttttccatgtg

SEQ ID NO: 3443 - DNA, 20 bp, Artificial Sequence
  Description of Artificial Sequence: Synthetic oligonucleotide
cttttctttgttgctttccg

SEQ ID NO: 3444 - DNA, 20 bp, Artificial Sequence
  Description of Artificial Sequence: Synthetic oligonucleotide
agttgttttccttttgtccg

SEQ ID NO: 3445 - DNA, 20 bp, Artificial Sequence
  Description of Artificial Sequence: Synthetic oligonucleotide
aatttgcttctttttatccg

SEQ ID NO: 3446 - DNA, 20 bp, Artificial Sequence
  Description of Artificial Sequence: Synthetic oligonucleotide
ctttcacttactttctaccg

SEQ ID NO: 3447 - DNA, 20 bp, Artificial Sequence
  Description of Artificial Sequence: Synthetic oligonucleotide
gttctttattcttctcaccg

SEQ ID NO: 3448 - DNA, 20 bp, Artificial Sequence
  Description of Artificial Sequence: Synthetic oligonucleotide
attttttacttctttcaccg

SEQ ID NO: 3449 - DNA, 20 bp, Artificial Sequence
  Description of Artificial Sequence: Synthetic oligonucleotide
tcctgtggtctgttcgtccc

SEQ ID NO: 3450 - DNA, 20 bp, Artificial Sequence
  Description of Artificial Sequence: Synthetic oligonucleotide
tttctctacactttttgccg

SEQ ID NO: 3451 - DNA, 20 bp, Artificial Sequence
  Description of Artificial Sequence: Synthetic oligonucleotide
cttactcatttctctctccg

SEQ ID NO: 3452 - DNA, 20 bp, Artificial Sequence
  Description of Artificial Sequence: Synthetic oligonucleotide
atttcctatcctttttaccg

SEQ ID NO: 3453 - DNA, 20 bp, Artificial Sequence
  Description of Artificial Sequence: Synthetic oligonucleotide
ctctttacttttctcctccg

SEQ ID NO: 3454 - DNA, 20 bp, Artificial Sequence
  Description of Artificial Sequence: Synthetic oligonucleotide
attttctatttattccaccg

SEQ ID NO: 3455 - DNA, 20 bp, Artificial Sequence
  Description of Artificial Sequence: Synthetic oligonucleotide
ttgttattctttttttgccc

SEQ ID NO: 3456 - DNA, 20 bp, Artificial Sequence
  Description of Artificial Sequence: Synthetic oligonucleotide
gtttcctttctcttttcccg

SEQ ID NO: 3457 - DNA, 20 bp, Artificial Sequence
  Description of Artificial Sequence: Synthetic oligonucleotide
tttcattattactttctgcc

SEQ ID NO: 3458 - DNA, 20 bp, Artificial Sequence
  Description of Artificial Sequence: Synthetic oligonucleotide
ctttttaccttctatttccg

SEQ ID NO: 3459 - DNA, 20 bp, Artificial Sequence
  Description of Artificial Sequence: Synthetic oligonucleotide
tcctctcgtctgttcgtccc

SEQ ID NO: 3460 - DNA, 20 bp, Artificial Sequence
  Description of Artificial Sequence: Synthetic oligonucleotide
cttttacctttctttatccg

SEQ ID NO: 3461 - DNA, 20 bp, Artificial Sequence
  Description of Artificial Sequence: Synthetic oligonucleotide
ttttccttattctttttccg

SEQ ID NO: 3462 - DNA, 20 bp, Artificial Sequence
  Description of Artificial Sequence: Synthetic oligonucleotide
ttatttttcttcgctgtccg

SEQ ID NO: 3463 - DNA, 20 bp, Artificial Sequence
  Description of Artificial Sequence: Synthetic oligonucleotide
tctttttttcactttctccg

SEQ ID NO: 3464 - DNA, 20 bp, Artificial Sequence
  Description of Artificial Sequence: Synthetic oligonucleotide
gttttacatttctttccccc

SEQ ID NO: 3465 - DNA, 20 bp, Artificial Sequence
  Description of Artificial Sequence: Synthetic oligonucleotide
tttctgacactttttttccg

SEQ ID NO: 3466 - DNA, 20 bp, Artificial Sequence
  Description of Artificial Sequence: Synthetic oligonucleotide
tttctttttcttcttctctg

SEQ ID NO: 3467 - DNA, 21 bp, Artificial Sequence
  Description of Artificial Sequence: Synthetic oligonucleotide
tttgggagtagggtggtaccg

SEQ ID NO: 3468 - DNA, 20 bp, Artificial Sequence
  Description of Artificial Sequence: Synthetic oligonucleotide
gttatttctctctttgtccg

SEQ ID NO: 3469 - DNA, 20 bp, Artificial Sequence
  Description of Artificial Sequence: Synthetic oligonucleotide
tttttctctttacgtttccg

SEQ ID NO: 3470 - DNA, 20 bp, Artificial Sequence
  Description of Artificial Sequence: Synthetic oligonucleotide
tttgttgttattgttgtccg

SEQ ID NO: 3471 - DNA, 20 bp, Artificial Sequence
  Description of Artificial Sequence: Synthetic oligonucleotide
tctatttcctttcttttccg

SEQ ID NO: 3472 - DNA, 20 bp, Artificial Sequence
  Description of Artificial Sequence: Synthetic oligonucleotide
ttttcttatatctctgtccg

SEQ ID NO: 3473 - DNA, 20 bp, Artificial Sequence
  Description of Artificial Sequence: Synthetic oligonucleotide
gattttgtctcttttacccg

SEQ ID NO: 3474 - DNA, 20 bp, Artificial Sequence
  Description of Artificial Sequence: Synthetic oligonucleotide
ttcgttatttcctttttccg

SEQ ID NO: 3475 - DNA, 20 bp, Artificial Sequence
  Description of Artificial Sequence: Synthetic oligonucleotide
tttttcctaccttttttccg

SEQ ID NO: 3476 - DNA, 20 bp, Artificial Sequence
  Description of Artificial Sequence: Synthetic oligonucleotide
ctttgttttactgttttccg

SEQ ID NO: 3477 - DNA, 20 bp, Artificial Sequence
  Description of Artificial Sequence: Synthetic oligonucleotide
tctttattttttcctttccg

SEQ ID NO: 3478 - DNA, 20 bp, Artificial Sequence
  Description of Artificial Sequence: Synthetic oligonucleotide
tgtttttgtttattttgccg

SEQ ID NO: 3479 - DNA, 20 bp, Artificial Sequence
  Description of Artificial Sequence: Synthetic oligonucleotide
gttattcttctctatttccg

SEQ ID NO: 3480 - DNA, 20 bp, Artificial Sequence
  Description of Artificial Sequence: Synthetic oligonucleotide
ctacttcttatttctttccg

SEQ ID NO: 3481 - DNA, 20 bp, Artificial Sequence
  Description of Artificial Sequence: Synthetic oligonucleotide
tttttcatttccttttcccg

SEQ ID NO: 3482 - DNA, 20 bp, Artificial Sequence
  Description of Artificial Sequence: Synthetic oligonucleotide
tatcttttgctttccctccg

SEQ ID NO: 3483 - DNA, 20 bp, Artificial Sequence
  Description of Artificial Sequence: Synthetic oligonucleotide
ttattatctttctcgctccg

SEQ ID NO: 3484 - DNA, 20 bp, Artificial Sequence
  Description of Artificial Sequence: Synthetic oligonucleotide
ttcttattccttctattccg

SEQ ID NO: 3485 - DNA, 20 bp, Artificial Sequence
  Description of Artificial Sequence: Synthetic oligonucleotide
cctttttactctctcttccg

SEQ ID NO: 3486 - DNA, 20 bp, Artificial Sequence
  Description of Artificial Sequence: Synthetic oligonucleotide
tcacttacttttttcctctg

SEQ ID NO: 3487 - DNA, 20 bp, Artificial Sequence
  Description of Artificial Sequence: Synthetic oligonucleotide
ttacttatttgctttttccc

SEQ ID NO: 3488 - DNA, 20 bp, Artificial Sequence
  Description of Artificial Sequence: Synthetic oligonucleotide
tttgtcaactttcttttccg

SEQ ID NO: 3489 - DNA, 20 bp, Artificial Sequence
  Description of Artificial Sequence: Synthetic oligonucleotide
atttttggtattttttaccg

SEQ ID NO: 3490 - DNA, 20 bp, Artificial Sequence
  Description of Artificial Sequence: Synthetic oligonucleotide
tttattctgttttttttccg

SEQ ID NO: 3491 - DNA, 20 bp, Artificial Sequence
  Description of Artificial Sequence: Synthetic oligonucleotide
actcacgttttcttcttccg

SEQ ID NO: 3492 - DNA, 20 bp, Artificial Sequence
  Description of Artificial Sequence: Synthetic oligonucleotide
ttactttcttctcttttccc

SEQ ID NO: 3493 - DNA, 21 bp, Artificial Sequence
  Description of Artificial Sequence: Synthetic oligonucleotide
tttgttttatttttttgtccc

SEQ ID NO: 3494 - DNA, 20 bp, Artificial Sequence
  Description of Artificial Sequence: Synthetic oligonucleotide
tttcttttttatttcccctg

SEQ ID NO: 3495 - DNA, 20 bp, Artificial Sequence
  Description of Artificial Sequence: Synthetic oligonucleotide
tgagtcacattttttacccc

SEQ ID NO: 3496 - DNA, 20 bp, Artificial Sequence
  Description of Artificial Sequence: Synthetic oligonucleotide
tttgggagtagggggttccg

SEQ ID NO: 3497 - DNA, 20 bp, Artificial Sequence
  Description of Artificial Sequence: Synthetic oligonucleotide
atttctcacttcttttaccg

SEQ ID NO: 3498 - DNA, 20 bp, Artificial Sequence
  Description of Artificial Sequence: Synthetic oligonucleotide
ctttcttttccttatttccg

SEQ ID NO: 3499 - DNA, 20 bp, Artificial Sequence
  Description of Artificial Sequence: Synthetic oligonucleotide
ttttttcacggttttttctg

SEQ ID NO: 3500 - DNA, 20 bp, Artificial Sequence
  Description of Artificial Sequence: Synthetic oligonucleotide
ttttgtcttttccttttccg

SEQ ID NO: 3501 - DNA, 20 bp, Artificial Sequence
  Description of Artificial Sequence: Synthetic oligonucleotide
attttctttcttcttttccg

SEQ ID NO: 3502 - DNA, 20 bp, Artificial Sequence
  Description of Artificial Sequence: Synthetic oligonucleotide
tttattttttcccgtttgtg

SEQ ID NO: 3503 - DNA, 20 bp, Artificial Sequence
  Description of Artificial Sequence: Synthetic oligonucleotide
tcttttttgtctttcttccg

SEQ ID NO: 3504 - DNA, 20 bp, Artificial Sequence
  Description of Artificial Sequence: Synthetic oligonucleotide
tttattcatttcttgttccc

SEQ ID NO: 3505 - DNA, 20 bp, Artificial Sequence
  Description of Artificial Sequence: Synthetic oligonucleotide
atttgttatttttgtttgcc

SEQ ID NO: 3506 - DNA, 20 bp, Artificial Sequence
  Description of Artificial Sequence: Synthetic oligonucleotide
gcctgtcgtctgttcgtccc

SEQ ID NO: 3507 - DNA, 20 bp, Artificial Sequence
  Description of Artificial Sequence: Synthetic oligonucleotide
tcttttcatttttcgttccg

SEQ ID NO: 3508 - DNA, 20 bp, Artificial Sequence
  Description of Artificial Sequence: Synthetic oligonucleotide
ttttccgttccttttttccg

SEQ ID NO: 3509 - DNA, 20 bp, Artificial Sequence
  Description of Artificial Sequence: Synthetic oligonucleotide
ctttttcttttctctttccg

SEQ ID NO: 3510 - DNA, 20 bp, Artificial Sequence
  Description of Artificial Sequence: Synthetic oligonucleotide
ttcgcttatctttatttccg

SEQ ID NO: 3511 - DNA, 20 bp, Artificial Sequence
  Description of Artificial Sequence: Synthetic oligonucleotide
tatttttattttctccgccg

SEQ ID NO: 3512 - DNA, 20 bp, Artificial Sequence
  Description of Artificial Sequence: Synthetic oligonucleotide
cttctatcttttctctaccg

SEQ ID NO: 3513 - DNA, 20 bp, Artificial Sequence
  Description of Artificial Sequence: Synthetic oligonucleotide
gttactttctttcttttccg

SEQ ID NO: 3514 - DNA, 20 bp, Artificial Sequence
  Description of Artificial Sequence: Synthetic oligonucleotide
ttttatttcttttttccccc

SEQ ID NO: 3515 - DNA, 20 bp, Artificial Sequence
  Description of Artificial Sequence: Synthetic oligonucleotide
agtttttgtcttttttcccc

SEQ ID NO: 3516 - DNA, 21 bp, Artificial Sequence
  Description of Artificial Sequence: Synthetic oligonucleotide
attttctctttttttctgccg

SEQ ID NO: 3517 - DNA, 20 bp, Artificial Sequence
  Description of Artificial Sequence: Synthetic oligonucleotide
ttttacattcatttttgcgc

SEQ ID NO: 3518 - DNA, 20 bp, Artificial Sequence
  Description of Artificial Sequence: Synthetic oligonucleotide
ccattcttttattttctccg

SEQ ID NO: 3519 - DNA, 20 bp, Artificial Sequence
  Description of Artificial Sequence: Synthetic oligonucleotide
ttttcattctttttttcccc

SEQ ID NO: 3520 - DNA, 20 bp, Artificial Sequence
  Description of Artificial Sequence: Synthetic oligonucleotide
tgttttatttgttttttccc

SEQ ID NO: 3521 - DNA, 20 bp, Artificial Sequence
  Description of Artificial Sequence: Synthetic oligonucleotide
ttttcttcttgcttcttccg

SEQ ID NO: 3522 - DNA, 20 bp, Artificial Sequence
  Description of Artificial Sequence: Synthetic oligonucleotide
attttttgttgttttgaccg

SEQ ID NO: 3523 - DNA, 20 bp, Artificial Sequence
  Description of Artificial Sequence: Synthetic oligonucleotide
tttcactcttttttccccgc

SEQ ID NO: 3524 - DNA, 20 bp, Artificial Sequence
  Description of Artificial Sequence: Synthetic oligonucleotide
aattctttatctttccaccg

SEQ ID NO: 3525 - DNA, 20 bp, Artificial Sequence
  Description of Artificial Sequence: Synthetic oligonucleotide
attcactcttttccttgccg

SEQ ID NO: 3526 - DNA, 21 bp, Artificial Sequence
  Description of Artificial Sequence: Synthetic oligonucleotide
cagttttactttttctttgcc

SEQ ID NO: 3527 - DNA, 21 bp, Artificial Sequence
  Description of Artificial Sequence: Synthetic oligonucleotide
aattgctctttttttctaccg

SEQ ID NO: 3528 - DNA, 20 bp, Artificial Sequence
  Description of Artificial Sequence: Synthetic oligonucleotide
cattttattatttctctccg

SEQ ID NO: 3529 - DNA, 20 bp, Artificial Sequence
  Description of Artificial Sequence: Synthetic oligonucleotide
actttttttcttttctaccg

SEQ ID NO: 3530 - DNA, 20 bp, Artificial Sequence
  Description of Artificial Sequence: Synthetic oligonucleotide
tttcttttcatttttttccg

SEQ ID NO: 3531 - DNA, 20 bp, Artificial Sequence
  Description of Artificial Sequence: Synthetic oligonucleotide
ctcttttttccctttctccg

SEQ ID NO: 3532 - DNA, 20 bp, Artificial Sequence
  Description of Artificial Sequence: Synthetic oligonucleotide
ctttactttttatttttccg

SEQ ID NO: 3533 - DNA, 20 bp, Artificial Sequence
  Description of Artificial Sequence: Synthetic oligonucleotide
tcctgtcgtcagttcgtccc

SEQ ID NO: 3534 - DNA, 20 bp, Artificial Sequence
  Description of Artificial Sequence: Synthetic oligonucleotide
tttatctttaactttttccg

SEQ ID NO: 3535 - DNA, 20 bp, Artificial Sequence
  Description of Artificial Sequence: Synthetic oligonucleotide
ttttctatcttttttgtccg

SEQ ID NO: 3536 - DNA, 20 bp, Artificial Sequence
  Description of Artificial Sequence: Synthetic oligonucleotide
gttcttgtttccttttaccg

SEQ ID NO: 3537 - DNA, 20 bp, Artificial Sequence
  Description of Artificial Sequence: Synthetic oligonucleotide
cttttccttttttcactccg

SEQ ID NO: 3538 - DNA, 20 bp, Artificial Sequence
  Description of Artificial Sequence: Synthetic oligonucleotide
tctactattttctccatccg

SEQ ID NO: 3539 - DNA, 20 bp, Artificial Sequence
  Description of Artificial Sequence: Synthetic oligonucleotide
tttgctttatattttgtccc

SEQ ID NO: 3540 - DNA, 19 bp, Artificial Sequence
  Description of Artificial Sequence: Synthetic oligonucleotide
tcctgtcgtctgttctccc

SEQ ID NO: 3541 - DNA, 20 bp, Artificial Sequence
  Description of Artificial Sequence: Synthetic oligonucleotide
ccttattgttcttgtttccg

SEQ ID NO: 3542 - DNA, 20 bp, Artificial Sequence
  Description of Artificial Sequence: Synthetic oligonucleotide
tatttactttctttcctccg

SEQ ID NO: 3543 - DNA, 20 bp, Artificial Sequence
  Description of Artificial Sequence: Synthetic oligonucleotide
tctcttatgtattctctccg

SEQ ID NO: 3544 - DNA, 20 bp, Artificial Sequence
  Description of Artificial Sequence: Synthetic oligonucleotide
ttttttagtctatttttccg

SEQ ID NO: 3545 - DNA, 20 bp, Artificial Sequence
  Description of Artificial Sequence: Synthetic oligonucleotide
tgaaggaggaggagggactg

SEQ ID NO: 3546 - DNA, 20 bp, Artificial Sequence
  Description of Artificial Sequence: Synthetic oligonucleotide
ttttcactatattttctccg

SEQ ID NO: 3547 - DNA, 20 bp, Artificial Sequence
  Description of Artificial Sequence: Synthetic oligonucleotide
attctctttttttcccaccg

SEQ ID NO: 3548 - DNA, 22 bp, Artificial Sequence
  Description of Artificial Sequence: Synthetic oligonucleotide
tttttctcacaattctcatccg

SEQ ID NO: 3549 - DNA, 20 bp, Artificial Sequence
  Description of Artificial Sequence: Synthetic oligonucleotide
attctttgattctttttccg

SEQ ID NO: 3550 - DNA, 20 bp, Artificial Sequence
  Description of Artificial Sequence: Synthetic oligonucleotide
tttccacggttttttttccg

SEQ ID NO: 3551 - DNA, 20 bp, Artificial Sequence
  Description of Artificial Sequence: Synthetic oligonucleotide
cttatttatttttctctccg

SEQ ID NO: 3552 - DNA, 20 bp, Artificial Sequence
  Description of Artificial Sequence: Synthetic oligonucleotide
tttgttttcttgattttccc

SEQ ID NO: 3553 - DNA, 22 bp, Artificial Sequence
  Description of Artificial Sequence: Synthetic oligonucleotide
aattatgtgtttttttgtgccg

SEQ ID NO: 3554 - DNA, 20 bp, Artificial Sequence
  Description of Artificial Sequence: Synthetic oligonucleotide
ctttctcttctcttcttccg

SEQ ID NO: 3555 - DNA, 20 bp, Artificial Sequence
  Description of Artificial Sequence: Synthetic oligonucleotide
ctttctttgtttcctctccg

SEQ ID NO: 3556 - DNA, 20 bp, Artificial Sequence
  Description of Artificial Sequence: Synthetic oligonucleotide
tcttttaacacctttttccg

SEQ ID NO: 3557 - DNA, 20 bp, Artificial Sequence
  Description of Artificial Sequence: Synthetic oligonucleotide
ttgtttctaccttttttccg

SEQ ID NO: 3558 - DNA, 20 bp, Artificial Sequence
  Description of Artificial Sequence: Synthetic oligonucleotide
tctgttttactttttttccc

SEQ ID NO: 3559 - DNA, 20 bp, Artificial Sequence
  Description of Artificial Sequence: Synthetic oligonucleotide
ttttatactgtttttcccgc

SEQ ID NO: 3560 - DNA, 20 bp, Artificial Sequence
  Description of Artificial Sequence: Synthetic oligonucleotide
ctttttcaacttcttttccg

SEQ ID NO: 3561 - DNA, 20 bp, Artificial Sequence
  Description of Artificial Sequence: Synthetic oligonucleotide
atttttctcctttttcaccg

SEQ ID NO: 3562 - DNA, 20 bp, Artificial Sequence
  Description of Artificial Sequence: Synthetic oligonucleotide
tctttatatcactttttccg

SEQ ID NO: 3563 - DNA, 20 bp, Artificial Sequence
  Description of Artificial Sequence: Synthetic oligonucleotide
tttctaatctcctttttccg

SEQ ID NO: 3564 - DNA, 20 bp, Artificial Sequence
  Description of Artificial Sequence: Synthetic oligonucleotide
tacttctttttttctctccg

SEQ ID NO: 3565 - DNA, 20 bp, Artificial Sequence
  Description of Artificial Sequence: Synthetic oligonucleotide
accttatctccttttctccg

SEQ ID NO: 3566 - DNA, 20 bp, Artificial Sequence
  Description of Artificial Sequence: Synthetic oligonucleotide
atcttttcccgctttttccg

SEQ ID NO: 3567 - DNA, 21 bp, Artificial Sequence
  Description of Artificial Sequence: Synthetic oligonucleotide
tttttccatattctctgtccg

SEQ ID NO: 3568 - DNA, 20 bp, Artificial Sequence
  Description of Artificial Sequence: Synthetic oligonucleotide
tttgggagtagggcgttccg

SEQ ID NO: 3569 - DNA, 20 bp, Artificial Sequence
  Description of Artificial Sequence: Synthetic oligonucleotide
atctttttgtttttcctccg

SEQ ID NO: 3570 - DNA, 20 bp, Artificial Sequence
  Description of Artificial Sequence: Synthetic oligonucleotide
tctcttttctttcttatccg

SEQ ID NO: 3571 - DNA, 20 bp, Artificial Sequence
  Description of Artificial Sequence: Synthetic oligonucleotide
acttctttatttttcttccg

SEQ ID NO: 3572 - DNA, 20 bp, Artificial Sequence
  Description of Artificial Sequence: Synthetic oligonucleotide
cattcttatctctttctccg

SEQ ID NO: 3573 - DNA, 20 bp, Artificial Sequence
  Description of Artificial Sequence: Synthetic oligonucleotide
aattcctttcttctttaccg

SEQ ID NO: 3574 - DNA, 20 bp, Artificial Sequence
  Description of Artificial Sequence: Synthetic oligonucleotide
tccttgtcgtctttcgtccc

SEQ ID NO: 3575 - DNA, 20 bp, Artificial Sequence
  Description of Artificial Sequence: Synthetic oligonucleotide
tctctttacctttcttgccg

SEQ ID NO: 3576 - DNA, 20 bp, Artificial Sequence
  Description of Artificial Sequence: Synthetic oligonucleotide
cttgggagtagggtgttccg

SEQ ID NO: 3577 - DNA, 20 bp, Artificial Sequence
  Description of Artificial Sequence: Synthetic oligonucleotide
tacttatctctctctttccg

SEQ ID NO: 3578 - DNA, 20 bp, Artificial Sequence
  Description of Artificial Sequence: Synthetic oligonucleotide
ttcttttctcgtttattccg

SEQ ID NO: 3579 - DNA, 21 bp, Artificial Sequence
  Description of Artificial Sequence: Synthetic oligonucleotide
tttttgttacgtttttttgcg

SEQ ID NO: 3580 - DNA, 20 bp, Artificial Sequence
  Description of Artificial Sequence: Synthetic oligonucleotide
actttcactgctttttgccg

SEQ ID NO: 3581 - DNA, 20 bp, Artificial Sequence
  Description of Artificial Sequence: Synthetic oligonucleotide
atctttgtatttctttaccg

SEQ ID NO: 3582 - DNA, 20 bp, Artificial Sequence
  Description of Artificial Sequence: Synthetic oligonucleotide
cttcttcatttttctttccg

SEQ ID NO: 3583 - DNA, 19 bp, Artificial Sequence
  Description of Artificial Sequence: Synthetic oligonucleotide
tttctttccttattttccg

SEQ ID NO: 3584 - DNA, 20 bp, Artificial Sequence
  Description of Artificial Sequence: Synthetic oligonucleotide
atttctttccactctttccg

SEQ ID NO: 3585 - DNA, 20 bp, Artificial Sequence
  Description of Artificial Sequence: Synthetic oligonucleotide
attttatccttcttctgccg

SEQ ID NO: 3586 - DNA, 20 bp, Artificial Sequence
  Description of Artificial Sequence: Synthetic oligonucleotide
tttttcaccttttgcttccg

SEQ ID NO: 3587 - DNA, 20 bp, Artificial Sequence
  Description of Artificial Sequence: Synthetic oligonucleotide
cttacttttcgcttcttccg

SEQ ID NO: 3588 - DNA, 20 bp, Artificial Sequence
  Description of Artificial Sequence: Synthetic oligonucleotide
ttcattctttcttttctgcc

SEQ ID NO: 3589 - DNA, 20 bp, Artificial Sequence
  Description of Artificial Sequence: Synthetic oligonucleotide
ttcactacttatttcttccg

SEQ ID NO: 3590 - DNA, 20 bp, Artificial Sequence
  Description of Artificial Sequence: Synthetic oligonucleotide
tttcactatttctttcccgc

SEQ ID NO: 3591 - DNA, 20 bp, Artificial Sequence
  Description of Artificial Sequence: Synthetic oligonucleotide
tattattgtttctttccccg

SEQ ID NO: 3592 - DNA, 20 bp, Artificial Sequence
  Description of Artificial Sequence: Synthetic oligonucleotide
tacttttgtttctttttccg

SEQ ID NO: 3593 - DNA, 20 bp, Artificial Sequence
  Description of Artificial Sequence: Synthetic oligonucleotide
ttttacttgttttttgtccg

SEQ ID NO: 3594 - DNA, 20 bp, Artificial Sequence
  Description of Artificial Sequence: Synthetic oligonucleotide
atcttgctgcttttttaccg

SEQ ID NO: 3595 - DNA, 20 bp, Artificial Sequence
  Description of Artificial Sequence: Synthetic oligonucleotide
atatttcttcttctttaccg

SEQ ID NO: 3596 - DNA, 20 bp, Artificial Sequence
  Description of Artificial Sequence: Synthetic oligonucleotide
ttcgtgcttttctttctccg

SEQ ID NO: 3597 - DNA, 20 bp, Artificial Sequence
  Description of Artificial Sequence: Synthetic oligonucleotide
tttgtgtttttcttgttccg

SEQ ID NO: 3598 - DNA, 20 bp, Artificial Sequence
  Description of Artificial Sequence: Synthetic oligonucleotide
ccattactttttcccatccg

SEQ ID NO: 3599 - DNA, 20 bp, Artificial Sequence
  Description of Artificial Sequence: Synthetic oligonucleotide
gttttctctcctttgttccg

SEQ ID NO: 3600 - DNA, 20 bp, Artificial Sequence
  Description of Artificial Sequence: Synthetic oligonucleotide
ttcgtttttactcttttccg

SEQ ID NO: 3601 - DNA, 19 bp, Artificial Sequence
  Description of Artificial Sequence: Synthetic oligonucleotide
tttcttattattctctccg

SEQ ID NO: 3602 - DNA, 20 bp, Artificial Sequence
  Description of Artificial Sequence: Synthetic oligonucleotide
tttgttcttttcttttcccc

SEQ ID NO: 3603 - DNA, 20 bp, Artificial Sequence
  Description of Artificial Sequence: Synthetic oligonucleotide
ctttcttacactttgctccg

SEQ ID NO: 3604 - DNA, 20 bp, Artificial Sequence
  Description of Artificial Sequence: Synthetic oligonucleotide
ttcttttctctcttcgtccg

SEQ ID NO: 3605 - DNA, 20 bp, Artificial Sequence
  Description of Artificial Sequence: Synthetic oligonucleotide
gactttcctttctttttccc

SEQ ID NO: 3606 - DNA, 20 bp, Artificial Sequence
  Description of Artificial Sequence: Synthetic oligonucleotide
tttctcttacatttcttccg

SEQ ID NO: 3607 - DNA, 20 bp, Artificial Sequence
  Description of Artificial Sequence: Synthetic oligonucleotide
ttttatttgttgtttgttgg

SEQ ID NO: 3608 - DNA, 20 bp, Artificial Sequence
  Description of Artificial Sequence: Synthetic oligonucleotide
tcttttgttcactatctccg

SEQ ID NO: 3609 - DNA, 20 bp, Artificial Sequence
  Description of Artificial Sequence: Synthetic oligonucleotide
cttttctcaatttcgctccg

SEQ ID NO: 3610 - DNA, 20 bp, Artificial Sequence
  Description of Artificial Sequence: Synthetic oligonucleotide
acatcttttctttcctaccg

SEQ ID NO: 3611 - DNA, 20 bp, Artificial Sequence
  Description of Artificial Sequence: Synthetic oligonucleotide
ttcttttcttactccttccg

SEQ ID NO: 3612 - DNA, 20 bp, Artificial Sequence
  Description of Artificial Sequence: Synthetic oligonucleotide
tttgttcttcttattccccg

SEQ ID NO: 3613 - DNA, 20 bp, Artificial Sequence
  Description of Artificial Sequence: Synthetic oligonucleotide
tattttgttttctgtttgcg

SEQ ID NO: 3614 - DNA, 20 bp, Artificial Sequence
  Description of Artificial Sequence: Synthetic oligonucleotide
atttggtctctttttcgccg

SEQ ID NO: 3615 - DNA, 20 bp, Artificial Sequence
  Description of Artificial Sequence: Synthetic oligonucleotide
tttgtttattcctttttccg

SEQ ID NO: 3616 - DNA, 20 bp, Artificial Sequence
  Description of Artificial Sequence: Synthetic oligonucleotide
cttcttgttttgtctttccg

SEQ ID NO: 3617 - DNA, 20 bp, Artificial Sequence
  Description of Artificial Sequence: Synthetic oligonucleotide
ttttatcttcttttgtgccg

SEQ ID NO: 3618 - DNA, 20 bp, Artificial Sequence
  Description of Artificial Sequence: Synthetic oligonucleotide
ttccgttcactttttttccg

SEQ ID NO: 3619 - DNA, 22 bp, Artificial Sequence
  Description of Artificial Sequence: Synthetic oligonucleotide
tttttcgtgtttttttgcaccg

SEQ ID NO: 3620 - DNA, 20 bp, Artificial Sequence
  Description of Artificial Sequence: Synthetic oligonucleotide
cattattatttttcgctccg

SEQ ID NO: 3621 - DNA, 20 bp, Artificial Sequence
  Description of Artificial Sequence: Synthetic oligonucleotide
tttgtttctctttgtctctg

SEQ ID NO: 3622 - DNA, 20 bp, Artificial Sequence
  Description of Artificial Sequence: Synthetic oligonucleotide
acttcttactttttcctccg

SEQ ID NO: 3623 - DNA, 20 bp, Artificial Sequence
  Description of Artificial Sequence: Synthetic oligonucleotide
actttcttctctttttgccg

SEQ ID NO: 3624 - DNA, 20 bp, Artificial Sequence
  Description of Artificial Sequence: Synthetic oligonucleotide
cttttttgttctttcatccg

SEQ ID NO: 3625 - DNA, 20 bp, Artificial Sequence
  Description of Artificial Sequence: Synthetic oligonucleotide
tttttgtctactttttaccg

SEQ ID NO: 3626 - DNA, 22 bp, Artificial Sequence
  Description of Artificial Sequence: Synthetic oligonucleotide
tttgtacgcgtttttttgtccg

SEQ ID NO: 3627 - DNA, 20 bp, Artificial Sequence
  Description of Artificial Sequence: Synthetic oligonucleotide
ctttttcgttttttcttccg

SEQ ID NO: 3628 - DNA, 20 bp, Artificial Sequence
  Description of Artificial Sequence: Synthetic oligonucleotide
ttttactttatctctttgtg

SEQ ID NO: 3629 - DNA, 18 bp, Artificial Sequence
  Description of Artificial Sequence: Synthetic oligonucleotide
tcctgtcgtctgttcccc

SEQ ID NO: 3630 - DNA, 19 bp, Artificial Sequence
  Description of Artificial Sequence: Synthetic oligonucleotide
cctgtcgtctgttcgtccc

SEQ ID NO: 3631 - DNA, 20 bp, Artificial Sequence
  Description of Artificial Sequence: Synthetic oligonucleotide
tcttttctctcttctcaccg

SEQ ID NO: 3632 - DNA, 20 bp, Artificial Sequence
  Description of Artificial Sequence: Synthetic oligonucleotide
tttgggggtagggtgttccg

SEQ ID NO: 3633 - DNA, 20 bp, Artificial Sequence
  Description of Artificial Sequence: Synthetic oligonucleotide
gtttttgttattgttttgcc

SEQ ID NO: 3634 - DNA, 21 bp, Artificial Sequence
  Description of Artificial Sequence: Synthetic oligonucleotide
ctttcactttttttccctccg

SEQ ID NO: 3635 - DNA, 20 bp, Artificial Sequence
  Description of Artificial Sequence: Synthetic oligonucleotide
gttctttgtcttttctcccg

SEQ ID NO: 3636 - DNA, 20 bp, Artificial Sequence
  Description of Artificial Sequence: Synthetic oligonucleotide
gttttgtattctttttcccc

SEQ ID NO: 3637 - DNA, 19 bp, Artificial Sequence
  Description of Artificial Sequence: Synthetic oligonucleotide
ccttttacttttttctccg

SEQ ID NO: 3638 - DNA, 20 bp, Artificial Sequence
  Description of Artificial Sequence: Synthetic oligonucleotide
ctatttactttccttctccg

SEQ ID NO: 3639 - DNA, 20 bp, Artificial Sequence
  Description of Artificial Sequence: Synthetic oligonucleotide
tttgttctgtcttatttccg

SEQ ID NO: 3640 - DNA, 21 bp, Artificial Sequence
  Description of Artificial Sequence: Synthetic oligonucleotide
ttgtgcgttttttttttgccg

SEQ ID NO: 3641 - DNA, 20 bp, Artificial Sequence
  Description of Artificial Sequence: Synthetic oligonucleotide
tctctttaattcttcttccg

SEQ ID NO: 3642 - DNA, 20 bp, Artificial Sequence
  Description of Artificial Sequence: Synthetic oligonucleotide
tatttctctttacttttccc

SEQ ID NO: 3643 - DNA, 21 bp, Artificial Sequence
  Description of Artificial Sequence: Synthetic oligonucleotide
tattttacgtttttttcgctg

SEQ ID NO: 3644 - DNA, 19 bp, Artificial Sequence
  Description of Artificial Sequence: Synthetic oligonucleotide
tcctgtcgtcgttcgtccc

SEQ ID NO: 3645 - DNA, 20 bp, Artificial Sequence
  Description of Artificial Sequence: Synthetic oligonucleotide
caccttttctttcttctccg

SEQ ID NO: 3646 - DNA, 20 bp, Artificial Sequence
  Description of Artificial Sequence: Synthetic oligonucleotide
ctttctctttgtcttttccg

SEQ ID NO: 3647 - DNA, 20 bp, Artificial Sequence
  Description of Artificial Sequence: Synthetic oligonucleotide
tctttcttcttttatctccg

SEQ ID NO: 3648 - DNA, 20 bp, Artificial Sequence
  Description of Artificial Sequence: Synthetic oligonucleotide
gtttttattctttttccccc

SEQ ID NO: 3649 - DNA, 20 bp, Artificial Sequence
  Description of Artificial Sequence: Synthetic oligonucleotide
gcttcttttctctttttccc

SEQ ID NO: 3650 - DNA, 20 bp, Artificial Sequence
  Description of Artificial Sequence: Synthetic oligonucleotide
tttacttttttattgctctg

SEQ ID NO: 3651 - DNA, 20 bp, Artificial Sequence
  Description of Artificial Sequence: Synthetic oligonucleotide
tgttttactattttttcccg

SEQ ID NO: 3652 - DNA, 20 bp, Artificial Sequence
  Description of Artificial Sequence: Synthetic oligonucleotide
aatttccttctcttctaccg

SEQ ID NO: 3653 - DNA, 20 bp, Artificial Sequence
  Description of Artificial Sequence: Synthetic oligonucleotide
tttatttcgcgttttctccg

SEQ ID NO: 3654 - DNA, 20 bp, Artificial Sequence
  Description of Artificial Sequence: Synthetic oligonucleotide
gtttcttcacttttcttccg

SEQ ID NO: 3655 - DNA, 22 bp, Artificial Sequence
  Description of Artificial Sequence: Synthetic oligonucleotide
ctttcacttttttttctctccg

SEQ ID NO: 3656 - DNA, 20 bp, Artificial Sequence
  Description of Artificial Sequence: Synthetic oligonucleotide
atattatttttctctcgccg

SEQ ID NO: 3657 - DNA, 20 bp, Artificial Sequence
  Description of Artificial Sequence: Synthetic oligonucleotide
tttctttattcattcctccg

SEQ ID NO: 3658 - DNA, 20 bp, Artificial Sequence
  Description of Artificial Sequence: Synthetic oligonucleotide
cctttttcgttttctatccg

SEQ ID NO: 3659 - DNA, 21 bp, Artificial Sequence
  Description of Artificial Sequence: Synthetic oligonucleotide
atttcactgtcttttttcccg

SEQ ID NO: 3660 - DNA, 21 bp, Artificial Sequence
  Description of Artificial Sequence: Synthetic oligonucleotide
acattttgttactttttactg

SEQ ID NO: 3661 - DNA, 21 bp, Artificial Sequence
  Description of Artificial Sequence: Synthetic oligonucleotide
tttcttgtctatttttttccg

SEQ ID NO: 3662 - DNA, 22 bp, Artificial Sequence
  Description of Artificial Sequence: Synthetic oligonucleotide
ttgtgcgtttttttttttgccg

SEQ ID NO: 3663 - DNA, 20 bp, Artificial Sequence
  Description of Artificial Sequence: Synthetic oligonucleotide
ttttccaagctttctctccg

SEQ ID NO: 3664 - DNA, 20 bp, Artificial Sequence
  Description of Artificial Sequence: Synthetic oligonucleotide
atttctttgtttctttgccc

SEQ ID NO: 3665 - DNA, 20 bp, Artificial Sequence
  Description of Artificial Sequence: Synthetic oligonucleotide
tattttacgttttttcgctg

SEQ ID NO: 3666 - DNA, 20 bp, Artificial Sequence
  Description of Artificial Sequence: Synthetic oligonucleotide
ttctctttttcttttcaccg

SEQ ID NO: 3667 - DNA, 20 bp, Artificial Sequence
  Description of Artificial Sequence: Synthetic oligonucleotide
tttcacacttttttttgctg

SEQ ID NO: 3668 - DNA, 20 bp, Artificial Sequence
  Description of Artificial Sequence: Synthetic oligonucleotide
attttgttatattgttgccg

SEQ ID NO: 3669 - DNA, 20 bp, Artificial Sequence
  Description of Artificial Sequence: Synthetic oligonucleotide
ctattttctctcttactccg

SEQ ID NO: 3670 - DNA, 20 bp, Artificial Sequence
  Description of Artificial Sequence: Synthetic oligonucleotide
ttcactactctttttctccg

SEQ ID NO: 3671 - DNA, 20 bp, Artificial Sequence
  Description of Artificial Sequence: Synthetic oligonucleotide
cttttctcgattactttccg

SEQ ID NO: 3672 - DNA, 20 bp, Artificial Sequence
  Description of Artificial Sequence: Synthetic oligonucleotide
tattttctatgctttttccg

SEQ ID NO: 3673 - DNA, 20 bp, Artificial Sequence
  Description of Artificial Sequence: Synthetic oligonucleotide
tacttttattcttttttccc

SEQ ID NO: 3674 - DNA, 20 bp, Artificial Sequence
  Description of Artificial Sequence: Synthetic oligonucleotide
tttttctctctatcgctccg

SEQ ID NO: 3675 - DNA, 20 bp, Artificial Sequence
  Description of Artificial Sequence: Synthetic oligonucleotide
aattcttttcttctcgtccg

SEQ ID NO: 3676 - DNA, 20 bp, Artificial Sequence
  Description of Artificial Sequence: Synthetic oligonucleotide
atttccgttcatttttgccg

SEQ ID NO: 3677 - DNA, 20 bp, Artificial Sequence
  Description of Artificial Sequence: Synthetic oligonucleotide
tttgtcatttttcttgtccg

SEQ ID NO: 3678 - DNA, 20 bp, Artificial Sequence
  Description of Artificial Sequence: Synthetic oligonucleotide
tcttcaacttttcttttccg

SEQ ID NO: 3679 - DNA, 20 bp, Artificial Sequence
  Description of Artificial Sequence: Synthetic oligonucleotide
accactattttctttttccg

SEQ ID NO: 3680 - DNA, 20 bp, Artificial Sequence
  Description of Artificial Sequence: Synthetic oligonucleotide
ttcttgtttacttttttccc

SEQ ID NO: 3681 - DNA, 21 bp, Artificial Sequence
  Description of Artificial Sequence: Synthetic oligonucleotide
agttttctttttgcttttctg

SEQ ID NO: 3682 - DNA, 22 bp, Artificial Sequence
  Description of Artificial Sequence: Synthetic oligonucleotide
aattatgttttttttgtgaccg

SEQ ID NO: 3683 - DNA, 20 bp, Artificial Sequence
  Description of Artificial Sequence: Synthetic oligonucleotide
tgtctttgctttttgttccg

SEQ ID NO: 3684 - DNA, 20 bp, Artificial Sequence
  Description of Artificial Sequence: Synthetic oligonucleotide
ttcttgctctttttcctccg

SEQ ID NO: 3685 - DNA, 20 bp, Artificial Sequence
  Description of Artificial Sequence: Synthetic oligonucleotide
ttctacttgtttttcccccg

SEQ ID NO: 3686 - DNA, 20 bp, Artificial Sequence
  Description of Artificial Sequence: Synthetic oligonucleotide
tctttttgtattcttctccg

SEQ ID NO: 3687 - DNA, 20 bp, Artificial Sequence
  Description of Artificial Sequence: Synthetic oligonucleotide
ttttcatactttttcccccg

SEQ ID NO: 3688 - DNA, 20 bp, Artificial Sequence
  Description of Artificial Sequence: Synthetic oligonucleotide
ttatttttgttttttgcgtg

SEQ ID NO: 3689 - DNA, 20 bp, Artificial Sequence
  Description of Artificial Sequence: Synthetic oligonucleotide
tttggggttttcccttgccc

SEQ ID NO: 3690 - DNA, 20 bp, Artificial Sequence
  Description of Artificial Sequence: Synthetic oligonucleotide
attttttatttcctgtgccg

SEQ ID NO: 3691 - DNA, 20 bp, Artificial Sequence
  Description of Artificial Sequence: Synthetic oligonucleotide
atcttcttattctttcgccg

SEQ ID NO: 3692 - DNA, 20 bp, Artificial Sequence
  Description of Artificial Sequence: Synthetic oligonucleotide
tctttttatttgtgtctccg

SEQ ID NO: 3693 - DNA, 20 bp, Artificial Sequence
  Description of Artificial Sequence: Synthetic oligonucleotide
tttctatatccttctttccg

SEQ ID NO: 3694 - DNA, 20 bp, Artificial Sequence
  Description of Artificial Sequence: Synthetic oligonucleotide
gactttctttttcttttccc

SEQ ID NO: 3695 - DNA, 20 bp, Artificial Sequence
  Description of Artificial Sequence: Synthetic oligonucleotide
cttttgtctttttctttccg

SEQ ID NO: 3696 - DNA, 20 bp, Artificial Sequence
  Description of Artificial Sequence: Synthetic oligonucleotide
attccacttttttttcaccg

SEQ ID NO: 3697 - DNA, 20 bp, Artificial Sequence
  Description of Artificial Sequence: Synthetic oligonucleotide
tttatttctttttatctccg

SEQ ID NO: 3698 - DNA, 21 bp, Artificial Sequence
  Description of Artificial Sequence: Synthetic oligonucleotide
ccttttacttttttttctccg

SEQ ID NO: 3699 - DNA, 21 bp, Artificial Sequence
  Description of Artificial Sequence: Synthetic oligonucleotide
tttgttgttgttttttttctg

SEQ ID NO: 3700 - DNA, 20 bp, Artificial Sequence
  Description of Artificial Sequence: Synthetic oligonucleotide
tttttttattgttgtttctg

SEQ ID NO: 3701 - DNA, 20 bp, Artificial Sequence
  Description of Artificial Sequence: Synthetic oligonucleotide
tttgggggtttcccgtgccc

SEQ ID NO: 3702 - DNA, 20 bp, Artificial Sequence
  Description of Artificial Sequence: Synthetic oligonucleotide
tattcttcttcttacctccg

SEQ ID NO: 3703 - DNA, 20 bp, Artificial Sequence
  Description of Artificial Sequence: Synthetic oligonucleotide
attcttctactcttattccg

SEQ ID NO: 3704 - DNA, 20 bp, Artificial Sequence
  Description of Artificial Sequence: Synthetic oligonucleotide
gttcttactttatcttgccg

SEQ ID NO: 3705 - DNA, 20 bp, Artificial Sequence
  Description of Artificial Sequence: Synthetic oligonucleotide
attttcatgtccctttaccg

SEQ ID NO: 3706 - DNA, 20 bp, Artificial Sequence
  Description of Artificial Sequence: Synthetic oligonucleotide
attttcaactccttttcccg

SEQ ID NO: 3707 - DNA, 20 bp, Artificial Sequence
  Description of Artificial Sequence: Synthetic oligonucleotide
ctattatccttttctttccg

SEQ ID NO: 3708 - DNA, 20 bp, Artificial Sequence
  Description of Artificial Sequence: Synthetic oligonucleotide
ctttcttttcacttcttccg

SEQ ID NO: 3709 - DNA, 20 bp, Artificial Sequence
  Description of Artificial Sequence: Synthetic oligonucleotide
gtttctttctaccttttccg

SEQ ID NO: 3710 - DNA, 21 bp, Artificial Sequence
  Description of Artificial Sequence: Synthetic oligonucleotide
cttcttgctttttttcccccg

SEQ ID NO: 3711 - DNA, 20 bp, Artificial Sequence
  Description of Artificial Sequence: Synthetic oligonucleotide
tatttttcttactttccccg

SEQ ID NO: 3712 - DNA, 20 bp, Artificial Sequence
  Description of Artificial Sequence: Synthetic oligonucleotide
tttctattttcttttttccc

SEQ ID NO: 3713 - DNA, 20 bp, Artificial Sequence
  Description of Artificial Sequence: Synthetic oligonucleotide
tccagtcgtctgttcgtccc

SEQ ID NO: 3714 - DNA, 19 bp, Artificial Sequence
  Description of Artificial Sequence: Synthetic oligonucleotide
tcctgtcgttgttcgtccc

SEQ ID NO: 3715 - DNA, 20 bp, Artificial Sequence
  Description of Artificial Sequence: Synthetic oligonucleotide
taattcttcctttttctccg

SEQ ID NO: 3716 - DNA, 20 bp, Artificial Sequence
  Description of Artificial Sequence: Synthetic oligonucleotide
cctttatattaccttctccg

SEQ ID NO: 3717 - DNA, 20 bp, Artificial Sequence
  Description of Artificial Sequence: Synthetic oligonucleotide
tcactttatatttctttccg

SEQ ID NO: 3718 - DNA, 20 bp, Artificial Sequence
  Description of Artificial Sequence: Synthetic oligonucleotide
tttttattatctctgctccg

SEQ ID NO: 3719 - DNA, 20 bp, Artificial Sequence
  Description of Artificial Sequence: Synthetic oligonucleotide
tatttatctttctttccccg

SEQ ID NO: 3720 - DNA, 20 bp, Artificial Sequence
  Description of Artificial Sequence: Synthetic oligonucleotide
ttcttttcacactttatccg

SEQ ID NO: 3721 - DNA, 20 bp, Artificial Sequence
  Description of Artificial Sequence: Synthetic oligonucleotide
tctcttttgtattcttcccg

SEQ ID NO: 3722 - DNA, 20 bp, Artificial Sequence
  Description of Artificial Sequence: Synthetic oligonucleotide
tttcttctatttttcttccg

SEQ ID NO: 3723 - DNA, 20 bp, Artificial Sequence
  Description of Artificial Sequence: Synthetic oligonucleotide
tttttacttttatttgcccg

SEQ ID NO: 3724 - DNA, 20 bp, Artificial Sequence
  Description of Artificial Sequence: Synthetic oligonucleotide
tttagctttttttccctccg

SEQ ID NO: 3725 - DNA, 20 bp, Artificial Sequence
  Description of Artificial Sequence: Synthetic oligonucleotide
tcttattccttctctttccg

SEQ ID NO: 3726 - DNA, 20 bp, Artificial Sequence
  Description of Artificial Sequence: Synthetic oligonucleotide
actttattgccttttcaccg

SEQ ID NO: 3727 - DNA, 20 bp, Artificial Sequence
  Description of Artificial Sequence: Synthetic oligonucleotide
tcattttatctttttcccgc

SEQ ID NO: 3728 - DNA, 20 bp, Artificial Sequence
  Description of Artificial Sequence: Synthetic oligonucleotide
tgttttcatttctctttccg

SEQ ID NO: 3729 - DNA, 20 bp, Artificial Sequence
  Description of Artificial Sequence: Synthetic oligonucleotide
tttctttcatttttctaccg

SEQ ID NO: 3730 - DNA, 20 bp, Artificial Sequence
  Description of Artificial Sequence: Synthetic oligonucleotide
atcttttcagctttttaccg

SEQ ID NO: 3731 - DNA, 20 bp, Artificial Sequence
  Description of Artificial Sequence: Synthetic oligonucleotide
actttctttcctttattctg

SEQ ID NO: 3732 - DNA, 20 bp, Artificial Sequence
  Description of Artificial Sequence: Synthetic oligonucleotide
ttcttacgtttccctttccg

SEQ ID NO: 3733 - DNA, 20 bp, Artificial Sequence
  Description of Artificial Sequence: Synthetic oligonucleotide
ctcatttcctttcttttccg

SEQ ID NO: 3734 - DNA, 20 bp, Artificial Sequence
  Description of Artificial Sequence: Synthetic oligonucleotide
ccatttcttttctcctaccg

SEQ ID NO: 3735 - DNA, 20 bp, Artificial Sequence
  Description of Artificial Sequence: Synthetic oligonucleotide
tttcttgattttcccttgtg

SEQ ID NO: 3736 - DNA, 20 bp, Artificial Sequence
  Description of Artificial Sequence: Synthetic oligonucleotide
gtttactttactttccaccg

SEQ ID NO: 3737 - DNA, 20 bp, Artificial Sequence
  Description of Artificial Sequence: Synthetic oligonucleotide
acattctctttttttcaccg

SEQ ID NO: 3738 - DNA, 20 bp, Artificial Sequence
  Description of Artificial Sequence: Synthetic oligonucleotide
ttactttgtttttttctccg

SEQ ID NO: 3739 - DNA, 20 bp, Artificial Sequence
  Description of Artificial Sequence: Synthetic oligonucleotide
tttgttattatttgtttccc

SEQ ID NO: 3740 - DNA, 20 bp, Artificial Sequence
  Description of Artificial Sequence: Synthetic oligonucleotide
tttgggagcagggtgttccg

SEQ ID NO: 3741 - DNA, 19 bp, Artificial Sequence
  Description of Artificial Sequence: Synthetic oligonucleotide
ttctttatttttccctccg

SEQ ID NO: 3742 - DNA, 20 bp, Artificial Sequence
  Description of Artificial Sequence: Synthetic oligonucleotide
atttctactttctctttccc

SEQ ID NO: 3743 - DNA, 20 bp, Artificial Sequence
  Description of Artificial Sequence: Synthetic oligonucleotide
actttttgctgttttttccc

SEQ ID NO: 3744 - DNA, 20 bp, Artificial Sequence
  Description of Artificial Sequence: Synthetic oligonucleotide
ttttattctttctttttgtg

SEQ ID NO: 3745 - DNA, 20 bp, Artificial Sequence
  Description of Artificial Sequence: Synthetic oligonucleotide
tctcattctcttcttctccg

SEQ ID NO: 3746 - DNA, 20 bp, Artificial Sequence
  Description of Artificial Sequence: Synthetic oligonucleotide
ccttttcttctcattctccg

SEQ ID NO: 3747 - DNA, 20 bp, Artificial Sequence
  Description of Artificial Sequence: Synthetic oligonucleotide
tttcattttctctacttccg

SEQ ID NO: 3748 - DNA, 20 bp, Artificial Sequence
  Description of Artificial Sequence: Synthetic oligonucleotide
tctctttacttcctcttccg

SEQ ID NO: 3749 - DNA, 20 bp, Artificial Sequence
  Description of Artificial Sequence: Synthetic oligonucleotide
atttctcttttttcgtcccg

SEQ ID NO: 3750 - DNA, 20 bp, Artificial Sequence
  Description of Artificial Sequence: Synthetic oligonucleotide
attctttaatccttttcccg

SEQ ID NO: 3751 - DNA, 20 bp, Artificial Sequence
  Description of Artificial Sequence: Synthetic oligonucleotide
ttattgattttgttttgcgc

SEQ ID NO: 3752 - DNA, 20 bp, Artificial Sequence
  Description of Artificial Sequence: Synthetic oligonucleotide
cttcatcttttttcttaccg

SEQ ID NO: 3753 - DNA, 20 bp, Artificial Sequence
  Description of Artificial Sequence: Synthetic oligonucleotide
atttctctatcctttttccc

SEQ ID NO: 3754 - DNA, 20 bp, Artificial Sequence
  Description of Artificial Sequence: Synthetic oligonucleotide
tttgctctctattttttccg

SEQ ID NO: 3755 - DNA, 20 bp, Artificial Sequence
  Description of Artificial Sequence: Synthetic oligonucleotide
ttttctctgattactttccg

SEQ ID NO: 3756 - DNA, 20 bp, Artificial Sequence
  Description of Artificial Sequence: Synthetic oligonucleotide
cttattatctccactttccg

SEQ ID NO: 3757 - DNA, 20 bp, Artificial Sequence
  Description of Artificial Sequence: Synthetic oligonucleotide
ttttactacttttttgcccg

SEQ ID NO: 3758 - DNA, 20 bp, Artificial Sequence
  Description of Artificial Sequence: Synthetic oligonucleotide
gtttttcttttctttttccg

SEQ ID NO: 3759 - DNA, 20 bp, Artificial Sequence
  Description of Artificial Sequence: Synthetic oligonucleotide
tttatttcttttcatgtgtg

SEQ ID NO: 3760 - DNA, 20 bp, Artificial Sequence
  Description of Artificial Sequence: Synthetic oligonucleotide
ttcttctcttttccctgccg

SEQ ID NO: 3761 - DNA, 20 bp, Artificial Sequence
  Description of Artificial Sequence: Synthetic oligonucleotide
cttctactcttatctttccg

SEQ ID NO: 3762 - DNA, 20 bp, Artificial Sequence
  Description of Artificial Sequence: Synthetic oligonucleotide
tttcttttacgttttttccc

SEQ ID NO: 3763 - DNA, 20 bp, Artificial Sequence
  Description of Artificial Sequence: Synthetic oligonucleotide
atttccttttatttttaccg

SEQ ID NO: 3764 - DNA, 21 bp, Artificial Sequence
  Description of Artificial Sequence: Synthetic oligonucleotide
tacttcttttttttctctccg

SEQ ID NO: 3765 - DNA, 20 bp, Artificial Sequence
  Description of Artificial Sequence: Synthetic oligonucleotide
tctttatggctttttctccg

SEQ ID NO: 3766 - DNA, 20 bp, Artificial Sequence
  Description of Artificial Sequence: Synthetic oligonucleotide
attttttatttttgctaccg

SEQ ID NO: 3767 - DNA, 21 bp, Artificial Sequence
  Description of Artificial Sequence: Synthetic oligonucleotide
atctttatttttttctctccg

SEQ ID NO: 3768 - DNA, 20 bp, Artificial Sequence
  Description of Artificial Sequence: Synthetic oligonucleotide
ctttttttcttttgttcccg

SEQ ID NO: 3769 - DNA, 20 bp, Artificial Sequence
  Description of Artificial Sequence: Synthetic oligonucleotide
ttacttatttcttctctgcc

SEQ ID NO: 3770 - DNA, 20 bp, Artificial Sequence
  Description of Artificial Sequence: Synthetic oligonucleotide
ttattttcccactctttccg

SEQ ID NO: 3771 - DNA, 20 bp, Artificial Sequence
  Description of Artificial Sequence: Synthetic oligonucleotide
tttgggaggagggtgttccg

SEQ ID NO: 3772 - DNA, 20 bp, Artificial Sequence
  Description of Artificial Sequence: Synthetic oligonucleotide
tttcttaccatttctttccg

SEQ ID NO: 3773 - DNA, 20 bp, Artificial Sequence
  Description of Artificial Sequence: Synthetic oligonucleotide
ttccatttttactttccccg

SEQ ID NO: 3774 - DNA, 20 bp, Artificial Sequence
  Description of Artificial Sequence: Synthetic oligonucleotide
ttttcacttatcttcttccg

SEQ ID NO: 3775 - DNA, 20 bp, Artificial Sequence
  Description of Artificial Sequence: Synthetic oligonucleotide
ctttttcttgctattttccg

SEQ ID NO: 3776 - DNA, 20 bp, Artificial Sequence
  Description of Artificial Sequence: Synthetic oligonucleotide
atttttttcctcttttaccg

SEQ ID NO: 3777 - DNA, 21 bp, Artificial Sequence
  Description of Artificial Sequence: Synthetic oligonucleotide
tttttgtcttgtttttttccg

SEQ ID NO: 3778 - DNA, 21 bp, Artificial Sequence
  Description of Artificial Sequence: Synthetic oligonucleotide
tcctgtcgtctgttcgttccc

SEQ ID NO: 3779 - DNA, 20 bp, Artificial Sequence
  Description of Artificial Sequence: Synthetic oligonucleotide
tccattcttcctttttgccg

SEQ ID NO: 3780 - DNA, 21 bp, Artificial Sequence
  Description of Artificial Sequence: Synthetic oligonucleotide
ttttcttgccctttttttccg

SEQ ID NO: 3781 - DNA, 20 bp, Artificial Sequence
  Description of Artificial Sequence: Synthetic oligonucleotide
tgctttttttcttttcgccg

SEQ ID NO: 3782 - DNA, 20 bp, Artificial Sequence
  Description of Artificial Sequence: Synthetic oligonucleotide
ctcatttcctattctctccg

SEQ ID NO: 3783 - DNA, 20 bp, Artificial Sequence
  Description of Artificial Sequence: Synthetic oligonucleotide
ttttttattcaccttctccg

SEQ ID NO: 3784 - DNA, 20 bp, Artificial Sequence
  Description of Artificial Sequence: Synthetic oligonucleotide
tttacatttcttttcttgcc

SEQ ID NO: 3785 - DNA, 20 bp, Artificial Sequence
  Description of Artificial Sequence: Synthetic oligonucleotide
cttctttgactttctttccg

SEQ ID NO: 3786 - DNA, 21 bp, Artificial Sequence
  Description of Artificial Sequence: Synthetic oligonucleotide
tttttttatggtttgtttccg

SEQ ID NO: 3787 - DNA, 20 bp, Artificial Sequence
  Description of Artificial Sequence: Synthetic oligonucleotide
tttttgttggtgtttttccg

SEQ ID NO: 3788 - DNA, 22 bp, Artificial Sequence
  Description of Artificial Sequence: Synthetic oligonucleotide
ctttatttttgtttttttgccc

SEQ ID NO: 3789 - DNA, 20 bp, Artificial Sequence
  Description of Artificial Sequence: Synthetic oligonucleotide
ttcactttattacttttccc

SEQ ID NO: 3790 - DNA, 20 bp, Artificial Sequence
  Description of Artificial Sequence: Synthetic oligonucleotide
cttcactcaatttctctccg

SEQ ID NO: 3791 - DNA, 21 bp, Artificial Sequence
  Description of Artificial Sequence: Synthetic oligonucleotide
ttttgggagtagggtgttccg

SEQ ID NO: 3792 - DNA, 20 bp, Artificial Sequence
  Description of Artificial Sequence: Synthetic oligonucleotide
cttcttttacctctcttccg

SEQ ID NO: 3793 - DNA, 20 bp, Artificial Sequence
  Description of Artificial Sequence: Synthetic oligonucleotide
ctttttccttttctactccg

SEQ ID NO: 3794 - DNA, 20 bp, Artificial Sequence
  Description of Artificial Sequence: Synthetic oligonucleotide
tttctcttcttttcttcccg

SEQ ID NO: 3795 - DNA, 20 bp, Artificial Sequence
  Description of Artificial Sequence: Synthetic oligonucleotide
actttcatattttttcaccg

SEQ ID NO: 3796 - DNA, 20 bp, Artificial Sequence
  Description of Artificial Sequence: Synthetic oligonucleotide
tttttgaacacttttttctg

SEQ ID NO: 3797 - DNA, 20 bp, Artificial Sequence
  Description of Artificial Sequence: Synthetic oligonucleotide
tttgggagtggggtgttccg

SEQ ID NO: 3798 - DNA, 20 bp, Artificial Sequence
  Description of Artificial Sequence: Synthetic oligonucleotide
atctttcttttatcctgccg

SEQ ID NO: 3799 - DNA, 20 bp, Artificial Sequence
  Description of Artificial Sequence: Synthetic oligonucleotide
cacttttcttcacctttccg

SEQ ID NO: 3800 - DNA, 20 bp, Artificial Sequence
  Description of Artificial Sequence: Synthetic oligonucleotide
ttttcgctgctttttccccg

SEQ ID NO: 3801 - DNA, 20 bp, Artificial Sequence
  Description of Artificial Sequence: Synthetic oligonucleotide
atagttttgttttttcgccg

SEQ ID NO: 3802 - DNA, 20 bp, Artificial Sequence
  Description of Artificial Sequence: Synthetic oligonucleotide
tttttgttgatttgtttgcc

SEQ ID NO: 3803 - DNA, 20 bp, Artificial Sequence
  Description of Artificial Sequence: Synthetic oligonucleotide
ctttctcttgctcttttccg

SEQ ID NO: 3804 - DNA, 20 bp, Artificial Sequence
  Description of Artificial Sequence: Synthetic oligonucleotide
tcttttcttcttattttccg

SEQ ID NO: 3805 - DNA, 22 bp, Artificial Sequence
  Description of Artificial Sequence: Synthetic oligonucleotide
aattatgtgttttttttgaccg

SEQ ID NO: 3806 - DNA, 20 bp, Artificial Sequence
  Description of Artificial Sequence: Synthetic oligonucleotide
ttttctctttaatcttgccg

SEQ ID NO: 3807 - DNA, 20 bp, Artificial Sequence
  Description of Artificial Sequence: Synthetic oligonucleotide
ttttatttcacttttacccg

SEQ ID NO: 3808 - DNA, 20 bp, Artificial Sequence
  Description of Artificial Sequence: Synthetic oligonucleotide
tttttccattttctcatccg

SEQ ID NO: 3809 - DNA, 20 bp, Artificial Sequence
  Description of Artificial Sequence: Synthetic oligonucleotide
atcttgctctttatttgccg

SEQ ID NO: 3810 - DNA, 20 bp, Artificial Sequence
  Description of Artificial Sequence: Synthetic oligonucleotide
ttcttacttttcaccttccg

SEQ ID NO: 3811 - DNA, 20 bp, Artificial Sequence
  Description of Artificial Sequence: Synthetic oligonucleotide
ttttttctatcttccgtccg

SEQ ID NO: 3812 - DNA, 20 bp, Artificial Sequence
  Description of Artificial Sequence: Synthetic oligonucleotide
ctttactgtttccttttccg

SEQ ID NO: 3813 - DNA, 20 bp, Artificial Sequence
  Description of Artificial Sequence: Synthetic oligonucleotide
tctttctttaactttttccg

SEQ ID NO: 3814 - DNA, 20 bp, Artificial Sequence
  Description of Artificial Sequence: Synthetic oligonucleotide
ccttttcatttctcttaccg

SEQ ID NO: 3815 - DNA, 20 bp, Artificial Sequence
  Description of Artificial Sequence: Synthetic oligonucleotide
atctcttgttatttttcccg

SEQ ID NO: 3816 - DNA, 21 bp, Artificial Sequence
  Description of Artificial Sequence: Synthetic oligonucleotide
tttgttttttctctttttccg

SEQ ID NO: 3817 - DNA, 20 bp, Artificial Sequence
  Description of Artificial Sequence: Synthetic oligonucleotide
ttctttgtttttttctcccg

SEQ ID NO: 3818 - DNA, 20 bp, Artificial Sequence
  Description of Artificial Sequence: Synthetic oligonucleotide
ttttcttcacttttttcccg

SEQ ID NO: 3819 - DNA, 20 bp, Artificial Sequence
  Description of Artificial Sequence: Synthetic oligonucleotide
ttttatcctcgttttctccg

SEQ ID NO: 3820 - DNA, 21 bp, Artificial Sequence
  Description of Artificial Sequence: Synthetic oligonucleotide
tttcactctttttttccccgc

SEQ ID NO: 3821 - DNA, 20 bp, Artificial Sequence
  Description of Artificial Sequence: Synthetic oligonucleotide
gttttgctcctttttcgccg

SEQ ID NO: 3822 - DNA, 20 bp, Artificial Sequence
  Description of Artificial Sequence: Synthetic oligonucleotide
ccttatgttttccctttccg

SEQ ID NO: 3823 - DNA, 20 bp, Artificial Sequence
  Description of Artificial Sequence: Synthetic oligonucleotide
acttttccctatcttttccg

SEQ ID NO: 3824 - DNA, 20 bp, Artificial Sequence
  Description of Artificial Sequence: Synthetic oligonucleotide
tatttttcacgtttcctccg

SEQ ID NO: 3825 - DNA, 20 bp, Artificial Sequence
  Description of Artificial Sequence: Synthetic oligonucleotide
cttttcctatttctactccg

SEQ ID NO: 3826 - DNA, 19 bp, Artificial Sequence
  Description of Artificial Sequence: Synthetic oligonucleotide
tttcttgttctttcttccg

SEQ ID NO: 3827 - DNA, 20 bp, Artificial Sequence
  Description of Artificial Sequence: Synthetic oligonucleotide
gttcttattattctctaccg

SEQ ID NO: 3828 - DNA, 20 bp, Artificial Sequence
  Description of Artificial Sequence: Synthetic oligonucleotide
atttttgacttttcttaccg

SEQ ID NO: 3829 - DNA, 20 bp, Artificial Sequence
  Description of Artificial Sequence: Synthetic oligonucleotide
tctttttctcgccttatccg

SEQ ID NO: 3830 - DNA, 20 bp, Artificial Sequence
  Description of Artificial Sequence: Synthetic oligonucleotide
attttatttattcgctaccg

SEQ ID NO: 3831 - DNA, 20 bp, Artificial Sequence
  Description of Artificial Sequence: Synthetic oligonucleotide
aattttctatccttttaccg

SEQ ID NO: 3832 - DNA, 20 bp, Artificial Sequence
  Description of Artificial Sequence: Synthetic oligonucleotide
tcttttttttgtttcccccg

SEQ ID NO: 3833 - DNA, 20 bp, Artificial Sequence
  Description of Artificial Sequence: Synthetic oligonucleotide
cttcatacttttttcttccg

SEQ ID NO: 3834 - DNA, 20 bp, Artificial Sequence
  Description of Artificial Sequence: Synthetic oligonucleotide
ttttttaatgtttttttccg

SEQ ID NO: 3835 - DNA, 20 bp, Artificial Sequence
  Description of Artificial Sequence: Synthetic oligonucleotide
ttgtgcgtttttttttgccg

SEQ ID NO: 3836 - DNA, 20 bp, Artificial Sequence
  Description of Artificial Sequence: Synthetic oligonucleotide
ttgttgttttattggttccg

SEQ ID NO: 3837 - DNA, 20 bp, Artificial Sequence
  Description of Artificial Sequence: Synthetic oligonucleotide
atttgtttaattttgttccc

SEQ ID NO: 3838 - DNA, 20 bp, Artificial Sequence
  Description of Artificial Sequence: Synthetic oligonucleotide
ttacttatttatttgctccg

SEQ ID NO: 3839 - DNA, 20 bp, Artificial Sequence
  Description of Artificial Sequence: Synthetic oligonucleotide
tctgttacactttttttccg

SEQ ID NO: 3840 - DNA, 20 bp, Artificial Sequence
  Description of Artificial Sequence: Synthetic oligonucleotide
cttctatttttcgcttaccg

SEQ ID NO: 3841 - DNA, 20 bp, Artificial Sequence
  Description of Artificial Sequence: Synthetic oligonucleotide
atttccttgtttttgttgtg

SEQ ID NO: 3842 - DNA, 20 bp, Artificial Sequence
  Description of Artificial Sequence: Synthetic oligonucleotide
tttctttcattttttttccg

SEQ ID NO: 3843 - DNA, 20 bp, Artificial Sequence
  Description of Artificial Sequence: Synthetic oligonucleotide
cttttctatcttttcttccg

SEQ ID NO: 3844 - DNA, 20 bp, Artificial Sequence
  Description of Artificial Sequence: Synthetic oligonucleotide
tattctcttgctttgctccg

SEQ ID NO: 3845 - DNA, 20 bp, Artificial Sequence
  Description of Artificial Sequence: Synthetic oligonucleotide
tctgggagtagggtgttccg

SEQ ID NO: 3846 - DNA, 20 bp, Artificial Sequence
  Description of Artificial Sequence: Synthetic oligonucleotide
attaggtgtagggtggactg

SEQ ID NO: 3847 - DNA, 20 bp, Artificial Sequence
  Description of Artificial Sequence: Synthetic oligonucleotide
attatcgttttctttcaccg

SEQ ID NO: 3848 - DNA, 20 bp, Artificial Sequence
  Description of Artificial Sequence: Synthetic oligonucleotide
ctttttttctccttttgctg

SEQ ID NO: 3849 - DNA, 20 bp, Artificial Sequence
  Description of Artificial Sequence: Synthetic oligonucleotide
tcatctttgtcttttttccg

SEQ ID NO: 3850 - DNA, 20 bp, Artificial Sequence
  Description of Artificial Sequence: Synthetic oligonucleotide
gtttttgttggttttttccg

SEQ ID NO: 3851 - DNA, 20 bp, Artificial Sequence
  Description of Artificial Sequence: Synthetic oligonucleotide
tttatttctcactttttgcg

SEQ ID NO: 3852 - DNA, 20 bp, Artificial Sequence
  Description of Artificial Sequence: Synthetic oligonucleotide
attttgcttttttactaccg

SEQ ID NO: 3853 - DNA, 20 bp, Artificial Sequence
  Description of Artificial Sequence: Synthetic oligonucleotide
attttactgttctctttccc

SEQ ID NO: 3854 - DNA, 20 bp, Artificial Sequence
  Description of Artificial Sequence: Synthetic oligonucleotide
attttccatggcttttaccg

SEQ ID NO: 3855 - DNA, 22 bp, Artificial Sequence
  Description of Artificial Sequence: Synthetic oligonucleotide
tttttacccttttttttgtccg

SEQ ID NO: 3856 - DNA, 20 bp, Artificial Sequence
  Description of Artificial Sequence: Synthetic oligonucleotide
atcatcactttcttttaccg

SEQ ID NO: 3857 - DNA, 20 bp, Artificial Sequence
  Description of Artificial Sequence: Synthetic oligonucleotide
ttgtttctttatttttcccg

SEQ ID NO: 3858 - DNA, 20 bp, Artificial Sequence
  Description of Artificial Sequence: Synthetic oligonucleotide
tctttttaacgtttcctccg

SEQ ID NO: 3859 - DNA, 20 bp, Artificial Sequence
  Description of Artificial Sequence: Synthetic oligonucleotide
ttttcactttttttcggctg

SEQ ID NO: 3860 - DNA, 20 bp, Artificial Sequence
  Description of Artificial Sequence: Synthetic oligonucleotide
ttctttttgtcatctctccg

SEQ ID NO: 3861 - DNA, 20 bp, Artificial Sequence
  Description of Artificial Sequence: Synthetic oligonucleotide
tttctcaactatcttttccg

SEQ ID NO: 3862 - DNA, 20 bp, Artificial Sequence
  Description of Artificial Sequence: Synthetic oligonucleotide
ttctttgttttattattccg

SEQ ID NO: 3863 - DNA, 20 bp, Artificial Sequence
  Description of Artificial Sequence: Synthetic oligonucleotide
tgttttatttgttttgcgtg

SEQ ID NO: 3864 - DNA, 20 bp, Artificial Sequence
  Description of Artificial Sequence: Synthetic oligonucleotide
tttgggagtagggagttccg

SEQ ID NO: 3865 - DNA, 20 bp, Artificial Sequence
  Description of Artificial Sequence: Synthetic oligonucleotide
tttgggagaagggtgttccg

SEQ ID NO: 3866 - DNA, 20 bp, Artificial Sequence
  Description of Artificial Sequence: Synthetic oligonucleotide
tgctttatttttccttcccg

SEQ ID NO: 3867 - DNA, 19 bp, Artificial Sequence
  Description of Artificial Sequence: Synthetic oligonucleotide
tttgttttatttttgtccc

SEQ ID NO: 3868 - DNA, 20 bp, Artificial Sequence
  Description of Artificial Sequence: Synthetic oligonucleotide
cttttcacttttttcttccg

SEQ ID NO: 3869 - DNA, 20 bp, Artificial Sequence
  Description of Artificial Sequence: Synthetic oligonucleotide
ttttatcttttgtttttgcg

SEQ ID NO: 3870 - DNA, 20 bp, Artificial Sequence
  Description of Artificial Sequence: Synthetic oligonucleotide
cgattcctctggctcgtccc

SEQ ID NO: 3871 - DNA, 20 bp, Artificial Sequence
  Description of Artificial Sequence: Synthetic oligonucleotide
tatcttctctttctcatccg

SEQ ID NO: 3872 - DNA, 20 bp, Artificial Sequence
  Description of Artificial Sequence: Synthetic oligonucleotide
tttccttttaacttgctccg

SEQ ID NO: 3873 - DNA, 20 bp, Artificial Sequence
  Description of Artificial Sequence: Synthetic oligonucleotide
attttggttatttttggccg

SEQ ID NO: 3874 - DNA, 22 bp, Artificial Sequence
  Description of Artificial Sequence: Synthetic oligonucleotide
attctctttttttttcccaccg

SEQ ID NO: 3875 - DNA, 20 bp, Artificial Sequence
  Description of Artificial Sequence: Synthetic oligonucleotide
gttttgtctttttccttccg

SEQ ID NO: 3876 - DNA, 20 bp, Artificial Sequence
  Description of Artificial Sequence: Synthetic oligonucleotide
ttcacttttttctcttgctg

SEQ ID NO: 3877 - DNA, 20 bp, Artificial Sequence
  Description of Artificial Sequence: Synthetic oligonucleotide
tattgctcttttattttccc

SEQ ID NO: 3878 - DNA, 20 bp, Artificial Sequence
  Description of Artificial Sequence: Synthetic oligonucleotide
ttccactttttttttctccg

SEQ ID NO: 3879 - DNA, 20 bp, Artificial Sequence
  Description of Artificial Sequence: Synthetic oligonucleotide
tttttgtaatgttttttccc

SEQ ID NO: 3880 - DNA, 20 bp, Artificial Sequence
  Description of Artificial Sequence: Synthetic oligonucleotide
tttattttcactttttcccg

SEQ ID NO: 3881 - DNA, 20 bp, Artificial Sequence
  Description of Artificial Sequence: Synthetic oligonucleotide
atattattttgttttttgcc

SEQ ID NO: 3882 - DNA, 20 bp, Artificial Sequence
  Description of Artificial Sequence: Synthetic oligonucleotide
ttttcttacgcgtttttccg

SEQ ID NO: 3883 - DNA, 20 bp, Artificial Sequence
  Description of Artificial Sequence: Synthetic oligonucleotide
tcactttctattcccttccg

SEQ ID NO: 3884 - DNA, 20 bp, Artificial Sequence
  Description of Artificial Sequence: Synthetic oligonucleotide
gatagaggaggtggtgcctg

SEQ ID NO: 3885 - DNA, 20 bp, Artificial Sequence
  Description of Artificial Sequence: Synthetic oligonucleotide
tttctcagtcttcttttccg

SEQ ID NO: 3886 - DNA, 20 bp, Artificial Sequence
  Description of Artificial Sequence: Synthetic oligonucleotide
cattttcctagttttctccg

SEQ ID NO: 3887 - DNA, 21 bp, Artificial Sequence
  Description of Artificial Sequence: Synthetic oligonucleotide
tcctgtcgtctgttccgtccc

SEQ ID NO: 3888 - DNA, 22 bp, Artificial Sequence
  Description of Artificial Sequence: Synthetic oligonucleotide
aattatgtgttttttgtgacct

SEQ ID NO: 3889 - DNA, 20 bp, Artificial Sequence
  Description of Artificial Sequence: Synthetic oligonucleotide
tcattatttcttctcctccg

SEQ ID NO: 3890 - DNA, 20 bp, Artificial Sequence
  Description of Artificial Sequence: Synthetic oligonucleotide
cctttattatactctctccg

SEQ ID NO: 3891 - DNA, 20 bp, Artificial Sequence
  Description of Artificial Sequence: Synthetic oligonucleotide
actactcggcattggtgccc

SEQ ID NO: 3892 - DNA, 20 bp, Artificial Sequence
  Description of Artificial Sequence: Synthetic oligonucleotide
tttcgctacacttttttccg

SEQ ID NO: 3893 - DNA, 21 bp, Artificial Sequence
  Description of Artificial Sequence: Synthetic oligonucleotide
tcttttttttgtgtttctccg

SEQ ID NO: 3894 - DNA, 21 bp, Artificial Sequence
  Description of Artificial Sequence: Synthetic oligonucleotide
ctatccttgttttttcttccg

SEQ ID NO: 3895 - DNA, 20 bp, Artificial Sequence
  Description of Artificial Sequence: Synthetic oligonucleotide
tttacttttctatctttccg

SEQ ID NO: 3896 - DNA, 20 bp, Artificial Sequence
  Description of Artificial Sequence: Synthetic oligonucleotide
gatttttcgctgttttaccc

SEQ ID NO: 3897 - DNA, 18 bp, Artificial Sequence
  Description of Artificial Sequence: Synthetic oligonucleotide
tttgtttttttgtttctg

SEQ ID NO: 3898 - DNA, 20 bp, Artificial Sequence
  Description of Artificial Sequence: Synthetic oligonucleotide
tttcaactttttcatttccc

SEQ ID NO: 3899 - DNA, 20 bp, Artificial Sequence
  Description of Artificial Sequence: Synthetic oligonucleotide
tttcatttattctttctgtg

SEQ ID NO: 3900 - DNA, 20 bp, Artificial Sequence
  Description of Artificial Sequence: Synthetic oligonucleotide
cataggagtagggtggtggc

SEQ ID NO: 3901 - DNA, 20 bp, Artificial Sequence
  Description of Artificial Sequence: Synthetic oligonucleotide
cttttctatttctccttccg

SEQ ID NO: 3902 - DNA, 20 bp, Artificial Sequence
  Description of Artificial Sequence: Synthetic oligonucleotide
gtttcttcttcttatttccg

SEQ ID NO: 3903 - DNA, 20 bp, Artificial Sequence
  Description of Artificial Sequence: Synthetic oligonucleotide
ctttactttttatctcaccg

SEQ ID NO: 3904 - DNA, 20 bp, Artificial Sequence
  Description of Artificial Sequence: Synthetic oligonucleotide
attctttcttttctgtcccg

SEQ ID NO: 3905 - DNA, 20 bp, Artificial Sequence
  Description of Artificial Sequence: Synthetic oligonucleotide
tttctttgtttgttttcgtg

SEQ ID NO: 3906 - DNA, 20 bp, Artificial Sequence
  Description of Artificial Sequence: Synthetic oligonucleotide
gtttttcattattctttccc

SEQ ID NO: 3907 - DNA, 19 bp, Artificial Sequence
  Description of Artificial Sequence: Synthetic oligonucleotide
tcctgtctctgttcgtccc

SEQ ID NO: 3908 - DNA, 20 bp, Artificial Sequence
  Description of Artificial Sequence: Synthetic oligonucleotide
attactcttctctcttgccg

SEQ ID NO: 3909 - DNA, 20 bp, Artificial Sequence
  Description of Artificial Sequence: Synthetic oligonucleotide
cgctttttgtttttcctcgc

SEQ ID NO: 3910 - DNA, 20 bp, Artificial Sequence
  Description of Artificial Sequence: Synthetic oligonucleotide
gtcttgtctatttttccccg

SEQ ID NO: 3911 - DNA, 20 bp, Artificial Sequence
  Description of Artificial Sequence: Synthetic oligonucleotide
actttctcttcttttatccc

SEQ ID NO: 3912 - DNA, 21 bp, Artificial Sequence
  Description of Artificial Sequence: Synthetic oligonucleotide
tttccttttttttcccatccg

SEQ ID NO: 3913 - DNA, 20 bp, Artificial Sequence
  Description of Artificial Sequence: Synthetic oligonucleotide
tcttttattcttctttaccg

SEQ ID NO: 3914 - DNA, 20 bp, Artificial Sequence
  Description of Artificial Sequence: Synthetic oligonucleotide
tcctgtcgtgtgttcgtccc

SEQ ID NO: 3915 - DNA, 18 bp, Artificial Sequence
  Description of Artificial Sequence: Synthetic oligonucleotide
attcttgcttttttgccg

SEQ ID NO: 3916 - DNA, 20 bp, Artificial Sequence
  Description of Artificial Sequence: Synthetic oligonucleotide
atctttttacactctcaccg

SEQ ID NO: 3917 - DNA, 20 bp, Artificial Sequence
  Description of Artificial Sequence: Synthetic oligonucleotide
ctttttacacttttatcccg

SEQ ID NO: 3918 - DNA, 20 bp, Artificial Sequence
  Description of Artificial Sequence: Synthetic oligonucleotide
attttatttccctttccccg

SEQ ID NO: 3919 - DNA, 20 bp, Artificial Sequence
  Description of Artificial Sequence: Synthetic oligonucleotide
ttttccattttttcactccg

SEQ ID NO: 3920 - DNA, 20 bp, Artificial Sequence
  Description of Artificial Sequence: Synthetic oligonucleotide
cttttattatttgtttaccg

SEQ ID NO: 3921 - DNA, 20 bp, Artificial Sequence
  Description of Artificial Sequence: Synthetic oligonucleotide
tcttatttctttcttccccg

SEQ ID NO: 3922 - DNA, 20 bp, Artificial Sequence
  Description of Artificial Sequence: Synthetic oligonucleotide
tttctttgtttcttttcctg

SEQ ID NO: 3923 - DNA, 20 bp, Artificial Sequence
  Description of Artificial Sequence: Synthetic oligonucleotide
tttggggttttcccgcgccc

SEQ ID NO: 3924 - DNA, 20 bp, Artificial Sequence
  Description of Artificial Sequence: Synthetic oligonucleotide
gttggggttttcccgtgccc

SEQ ID NO: 3925 - DNA, 20 bp, Artificial Sequence
  Description of Artificial Sequence: Synthetic oligonucleotide
caattggtggaggtgggctg

SEQ ID NO: 3926 - DNA, 20 bp, Artificial Sequence
  Description of Artificial Sequence: Synthetic oligonucleotide
atttctcgatcttttctccg

SEQ ID NO: 3927 - DNA, 20 bp, Artificial Sequence
  Description of Artificial Sequence: Synthetic oligonucleotide
tttactctcttacttctccg

SEQ ID NO: 3928 - DNA, 21 bp, Artificial Sequence
  Description of Artificial Sequence: Synthetic oligonucleotide
tttttcgtgttttttgcaccg

SEQ ID NO: 3929 - DNA, 20 bp, Artificial Sequence
  Description of Artificial Sequence: Synthetic oligonucleotide
tttgttgccccttttttccg

SEQ ID NO: 3930 - DNA, 20 bp, Artificial Sequence
  Description of Artificial Sequence: Synthetic oligonucleotide
ttttaacattaccttttccc

SEQ ID NO: 3931 - DNA, 20 bp, Artificial Sequence
  Description of Artificial Sequence: Synthetic oligonucleotide
attcctactttttttccccg

SEQ ID NO: 3932 - DNA, 20 bp, Artificial Sequence
  Description of Artificial Sequence: Synthetic oligonucleotide
ccttttcattttctattccg

SEQ ID NO: 3933 - DNA, 20 bp, Artificial Sequence
  Description of Artificial Sequence: Synthetic oligonucleotide
ttttcactttttcttttgcc

SEQ ID NO: 3934 - DNA, 20 bp, Artificial Sequence
  Description of Artificial Sequence: Synthetic oligonucleotide
ttttttcattatcttgtccc

SEQ ID NO: 3935 - DNA, 20 bp, Artificial Sequence
  Description of Artificial Sequence: Synthetic oligonucleotide
caaagggaggtgtagggtgc

SEQ ID NO: 3936 - DNA, 20 bp, Artificial Sequence
  Description of Artificial Sequence: Synthetic oligonucleotide
gttcttagtctttctttccg

SEQ ID NO: 3937 - DNA, 21 bp, Artificial Sequence
  Description of Artificial Sequence: Synthetic oligonucleotide
tttatttctttccacgttcct

SEQ ID NO: 3938 - DNA, 20 bp, Artificial Sequence
  Description of Artificial Sequence: Synthetic oligonucleotide
ttttacaaaatttcgctccg

SEQ ID NO: 3939 - DNA, 20 bp, Artificial Sequence
  Description of Artificial Sequence: Synthetic oligonucleotide
tctttactttttttcacccg

SEQ ID NO: 3940 - DNA, 20 bp, Artificial Sequence
  Description of Artificial Sequence: Synthetic oligonucleotide
ttattttttgcctgcttccg

SEQ ID NO: 3941 - DNA, 20 bp, Artificial Sequence
  Description of Artificial Sequence: Synthetic oligonucleotide
ttttttatacaccttttccg

SEQ ID NO: 3942 - DNA, 21 bp, Artificial Sequence
  Description of Artificial Sequence: Synthetic oligonucleotide
tttttatttcgtgtttttgcg

SEQ ID NO: 3943 - DNA, 20 bp, Artificial Sequence
  Description of Artificial Sequence: Synthetic oligonucleotide
ttctttatttctatcttccg

SEQ ID NO: 3944 - DNA, 20 bp, Artificial Sequence
  Description of Artificial Sequence: Synthetic oligonucleotide
tcctttcgttcttccctccc

SEQ ID NO: 3945 - DNA, 20 bp, Artificial Sequence
  Description of Artificial Sequence: Synthetic oligonucleotide
ttccattcgctttttctccg

SEQ ID NO: 3946 - DNA, 19 bp, Artificial Sequence
  Description of Artificial Sequence: Synthetic oligonucleotide
cattacttcttcttctccg

SEQ ID NO: 3947 - DNA, 20 bp, Artificial Sequence
  Description of Artificial Sequence: Synthetic oligonucleotide
ttttcttgttgtttttgccc

SEQ ID NO: 3948 - DNA, 20 bp, Artificial Sequence
  Description of Artificial Sequence: Synthetic oligonucleotide
ctttatttcactctttaccg

SEQ ID NO: 3949 - DNA, 20 bp, Artificial Sequence
  Description of Artificial Sequence: Synthetic oligonucleotide
cttctttgttcgtttttccg

SEQ ID NO: 3950 - DNA, 20 bp, Artificial Sequence
  Description of Artificial Sequence: Synthetic oligonucleotide
ttttcgcttttctttatccg

SEQ ID NO: 3951 - DNA, 20 bp, Artificial Sequence
  Description of Artificial Sequence: Synthetic oligonucleotide
tctcttataacttctttccg

SEQ ID NO: 3952 - DNA, 20 bp, Artificial Sequence
  Description of Artificial Sequence: Synthetic oligonucleotide
ttttatctctgttttttgcc

SEQ ID NO: 3953 - DNA, 20 bp, Artificial Sequence
  Description of Artificial Sequence: Synthetic oligonucleotide
tttttccatttctttacccg

SEQ ID NO: 3954 - DNA, 20 bp, Artificial Sequence
  Description of Artificial Sequence: Synthetic oligonucleotide
ttcatttgttctttttcccg

SEQ ID NO: 3955 - DNA, 20 bp, Artificial Sequence
  Description of Artificial Sequence: Synthetic oligonucleotide
tttttcgccatttttccccg

SEQ ID NO: 3956 - DNA, 21 bp, Artificial Sequence
  Description of Artificial Sequence: Synthetic oligonucleotide
ttccacttttttttttctccg

SEQ ID NO: 3957 - DNA, 20 bp, Artificial Sequence
  Description of Artificial Sequence: Synthetic oligonucleotide
cctttttcttttttctaccg

SEQ ID NO: 3958 - DNA, 20 bp, Artificial Sequence
  Description of Artificial Sequence: Synthetic oligonucleotide
tcttttttcttctttctccg

SEQ ID NO: 3959 - DNA, 20 bp, Artificial Sequence
  Description of Artificial Sequence: Synthetic oligonucleotide
tctttttctacttttacccg

SEQ ID NO: 3960 - DNA, 20 bp, Artificial Sequence
  Description of Artificial Sequence: Synthetic oligonucleotide
ctttattattttccttcccg

SEQ ID NO: 3961 - DNA, 20 bp, Artificial Sequence
  Description of Artificial Sequence: Synthetic oligonucleotide
gttccatttctcttttgccg

SEQ ID NO: 3962 - DNA, 20 bp, Artificial Sequence
  Description of Artificial Sequence: Synthetic oligonucleotide
tttttcttcttttagttccg

SEQ ID NO: 3963 - DNA, 20 bp, Artificial Sequence
  Description of Artificial Sequence: Synthetic oligonucleotide
tgtttttttccctttccccg

SEQ ID NO: 3964 - DNA, 21 bp, Artificial Sequence
  Description of Artificial Sequence: Synthetic oligonucleotide
gtatctcttttcttttctccg

SEQ ID NO: 3965 - DNA, 20 bp, Artificial Sequence
  Description of Artificial Sequence: Synthetic oligonucleotide
tcttttcattgctctttccg

SEQ ID NO: 3966 - DNA, 20 bp, Artificial Sequence
  Description of Artificial Sequence: Synthetic oligonucleotide
tttttttctccggttttccg

SEQ ID NO: 3967 - DNA, 20 bp, Artificial Sequence
  Description of Artificial Sequence: Synthetic oligonucleotide
acctttctaatctttctccg

SEQ ID NO: 3968 - DNA, 20 bp, Artificial Sequence
  Description of Artificial Sequence: Synthetic oligonucleotide
atcctttttgtttttcgccg

SEQ ID NO: 3969 - DNA, 20 bp, Artificial Sequence
  Description of Artificial Sequence: Synthetic oligonucleotide
ttttttctatctcttctccg

SEQ ID NO: 3970 - DNA, 20 bp, Artificial Sequence
  Description of Artificial Sequence: Synthetic oligonucleotide
ttttcatgactttttgcccg

SEQ ID NO: 3971 - DNA, 21 bp, Artificial Sequence
  Description of Artificial Sequence: Synthetic oligonucleotide
attcttgctttttttttgccg

SEQ ID NO: 3972 - DNA, 20 bp, Artificial Sequence
  Description of Artificial Sequence: Synthetic oligonucleotide
tttactgtttcctttttcgc

SEQ ID NO: 3973 - DNA, 20 bp, Artificial Sequence
  Description of Artificial Sequence: Synthetic oligonucleotide
ctttttattctttttcaccg

SEQ ID NO: 3974 - DNA, 20 bp, Artificial Sequence
  Description of Artificial Sequence: Synthetic oligonucleotide
acttttgttactttttaccc

SEQ ID NO: 3975 - DNA, 20 bp, Artificial Sequence
  Description of Artificial Sequence: Synthetic oligonucleotide
ttacctttccttttactccg

SEQ ID NO: 3976 - DNA, 20 bp, Artificial Sequence
  Description of Artificial Sequence: Synthetic oligonucleotide
tttattttcctgtgcttccg

SEQ ID NO: 3977 - DNA, 20 bp, Artificial Sequence
  Description of Artificial Sequence: Synthetic oligonucleotide
cttatttcattcctcttccg

SEQ ID NO: 3978 - DNA, 20 bp, Artificial Sequence
  Description of Artificial Sequence: Synthetic oligonucleotide
aatttctcgtttttttgctg

SEQ ID NO: 3979 - DNA, 21 bp, Artificial Sequence
  Description of Artificial Sequence: Synthetic oligonucleotide
tcattactgtttttttatccg

SEQ ID NO: 3980 - DNA, 20 bp, Artificial Sequence
  Description of Artificial Sequence: Synthetic oligonucleotide
cctatttctttcttcttccg

SEQ ID NO: 3981 - DNA, 20 bp, Artificial Sequence
  Description of Artificial Sequence: Synthetic oligonucleotide
tttttactctttttggtccc

SEQ ID NO: 3982 - DNA, 20 bp, Artificial Sequence
  Description of Artificial Sequence: Synthetic oligonucleotide
accttttgtcttttttaccg

SEQ ID NO: 3983 - DNA, 20 bp, Artificial Sequence
  Description of Artificial Sequence: Synthetic oligonucleotide
tattttctaccttttttccg

SEQ ID NO: 3984 - DNA, 20 bp, Artificial Sequence
  Description of Artificial Sequence: Synthetic oligonucleotide
tatttcttttattccttgtg

SEQ ID NO: 3985 - DNA, 21 bp, Artificial Sequence
  Description of Artificial Sequence: Synthetic oligonucleotide
actttttttctctcctttccg

SEQ ID NO: 3986 - DNA, 20 bp, Artificial Sequence
  Description of Artificial Sequence: Synthetic oligonucleotide
atttttcatttgctctaccg

SEQ ID NO: 3987 - DNA, 20 bp, Artificial Sequence
  Description of Artificial Sequence: Synthetic oligonucleotide
ttatttacctttcctttccg

SEQ ID NO: 3988 - DNA, 20 bp, Artificial Sequence
  Description of Artificial Sequence: Synthetic oligonucleotide
ttctttttgtttttccccgg

SEQ ID NO: 3989 - DNA, 20 bp, Artificial Sequence
  Description of Artificial Sequence: Synthetic oligonucleotide
ttattgctttttttggtccg

SEQ ID NO: 3990 - DNA, 20 bp, Artificial Sequence
  Description of Artificial Sequence: Synthetic oligonucleotide
ttatttaactcctttctccg

SEQ ID NO: 3991 - DNA, 21 bp, Artificial Sequence
  Description of Artificial Sequence: Synthetic oligonucleotide
cattcttctgttttccttcgc

SEQ ID NO: 3992 - DNA, 20 bp, Artificial Sequence
  Description of Artificial Sequence: Synthetic oligonucleotide
tttcacttttattcctgccg

SEQ ID NO: 3993 - DNA, 20 bp, Artificial Sequence
  Description of Artificial Sequence: Synthetic oligonucleotide
ctttcacttttttctctccg

SEQ ID NO: 3994 - DNA, 20 bp, Artificial Sequence
  Description of Artificial Sequence: Synthetic oligonucleotide
tttttaatgttcttcgtccg

SEQ ID NO: 3995 - DNA, 20 bp, Artificial Sequence
  Description of Artificial Sequence: Synthetic oligonucleotide
tgttttttctattgttcccg

SEQ ID NO: 3996 - DNA, 20 bp, Artificial Sequence
  Description of Artificial Sequence: Synthetic oligonucleotide
tctttaattcgcttttcccg

SEQ ID NO: 3997 - DNA, 20 bp, Artificial Sequence
  Description of Artificial Sequence: Synthetic oligonucleotide
gtttattatctttcctaccg

SEQ ID NO: 3998 - DNA, 20 bp, Artificial Sequence
  Description of Artificial Sequence: Synthetic oligonucleotide
tttggttttaatttttcccg

SEQ ID NO: 3999 - DNA, 20 bp, Artificial Sequence
  Description of Artificial Sequence: Synthetic oligonucleotide
tattgttcatgttttctctg

SEQ ID NO: 4000 - DNA, 19 bp, Artificial Sequence
  Description of Artificial Sequence: Synthetic oligonucleotide
ttattttttgtttgttgtg

SEQ ID NO: 4001 - DNA, 20 bp, Artificial Sequence
  Description of Artificial Sequence: Synthetic oligonucleotide
tttggggttttcccatgccc

SEQ ID NO: 4002 - DNA, 20 bp, Artificial Sequence
  Description of Artificial Sequence: Synthetic oligonucleotide
aattatgtgttttgtgaccg

SEQ ID NO: 4003 - DNA, 20 bp, Artificial Sequence
  Description of Artificial Sequence: Synthetic oligonucleotide
ttatttttgttaccgttccg

SEQ ID NO: 4004 - DNA, 20 bp, Artificial Sequence
  Description of Artificial Sequence: Synthetic oligonucleotide
ggtgtgttaccctactgcgc

SEQ ID NO: 4005 - DNA, 20 bp, Artificial Sequence
  Description of Artificial Sequence: Synthetic oligonucleotide
tactttccttttgctctccg

SEQ ID NO: 4006 - DNA, 20 bp, Artificial Sequence
  Description of Artificial Sequence: Synthetic oligonucleotide
tttttccatttatttcgccg

SEQ ID NO: 4007 - DNA, 20 bp, Artificial Sequence
  Description of Artificial Sequence: Synthetic oligonucleotide
ctatactcttctcttttccg

SEQ ID NO: 4008 - DNA, 21 bp, Artificial Sequence
  Description of Artificial Sequence: Synthetic oligonucleotide
ttttacttgtttttttgtccg

SEQ ID NO: 4009 - DNA, 20 bp, Artificial Sequence
  Description of Artificial Sequence: Synthetic oligonucleotide
ttctattttcgtttcttccg

SEQ ID NO: 4010 - DNA, 20 bp, Artificial Sequence
  Description of Artificial Sequence: Synthetic oligonucleotide
ttttctcattacattttccg

SEQ ID NO: 4011 - DNA, 20 bp, Artificial Sequence
  Description of Artificial Sequence: Synthetic oligonucleotide
actttttattctttctactg

SEQ ID NO: 4012 - DNA, 20 bp, Artificial Sequence
  Description of Artificial Sequence: Synthetic oligonucleotide
acttactgttttcttttccg

SEQ ID NO: 4013 - DNA, 20 bp, Artificial Sequence
  Description of Artificial Sequence: Synthetic oligonucleotide
atttctttctttttcctctg

SEQ ID NO: 4014 - DNA, 20 bp, Artificial Sequence
  Description of Artificial Sequence: Synthetic oligonucleotide
cttttttctgtttttatccg

SEQ ID NO: 4015 - DNA, 20 bp, Artificial Sequence
  Description of Artificial Sequence: Synthetic oligonucleotide
ttctttgcttttattttccc

SEQ ID NO: 4016 - DNA, 21 bp, Artificial Sequence
  Description of Artificial Sequence: Synthetic oligonucleotide
attcgtttttttcttgttccg

SEQ ID NO: 4017 - DNA, 20 bp, Artificial Sequence
  Description of Artificial Sequence: Synthetic oligonucleotide
ttttccttcgcttctttccg

SEQ ID NO: 4018 - DNA, 19 bp, Artificial Sequence
  Description of Artificial Sequence: Synthetic oligonucleotide
tctcatctacttttctccg

SEQ ID NO: 4019 - DNA, 20 bp, Artificial Sequence
  Description of Artificial Sequence: Synthetic oligonucleotide
gtatttctcttttctctccg

SEQ ID NO: 4020 - DNA, 20 bp, Artificial Sequence
  Description of Artificial Sequence: Synthetic oligonucleotide
tcttttgttattcttgtccc

SEQ ID NO: 4021 - DNA, 20 bp, Artificial Sequence
  Description of Artificial Sequence: Synthetic oligonucleotide
tttctttattctactctccg

SEQ ID NO: 4022 - DNA, 20 bp, Artificial Sequence
  Description of Artificial Sequence: Synthetic oligonucleotide
tgtagtggaggtggtgtgcg

SEQ ID NO: 4023 - DNA, 20 bp, Artificial Sequence
  Description of Artificial Sequence: Synthetic oligonucleotide
cttctactcactttcttccg

SEQ ID NO: 4024 - DNA, 20 bp, Artificial Sequence
  Description of Artificial Sequence: Synthetic oligonucleotide
tattttgttctctttttgcc

SEQ ID NO: 4025 - DNA, 21 bp, Artificial Sequence
  Description of Artificial Sequence: Synthetic oligonucleotide
atttcacgttgttttttaccg

SEQ ID NO: 4026 - DNA, 20 bp, Artificial Sequence
  Description of Artificial Sequence: Synthetic oligonucleotide
cttactcttactttttaccg

SEQ ID NO: 4027 - DNA, 20 bp, Artificial Sequence
  Description of Artificial Sequence: Synthetic oligonucleotide
tttttacttttttcgttccg

SEQ ID NO: 4028 - DNA, 20 bp, Artificial Sequence
  Description of Artificial Sequence: Synthetic oligonucleotide
tttcatatttctttcttcgc

SEQ ID NO: 4029 - DNA, 19 bp, Artificial Sequence
  Description of Artificial Sequence: Synthetic oligonucleotide
cttttttcttttttctccg

SEQ ID NO: 4030 - DNA, 20 bp, Artificial Sequence
  Description of Artificial Sequence: Synthetic oligonucleotide
ccttttttctttgttttccg

SEQ ID NO: 4031 - DNA, 20 bp, Artificial Sequence
  Description of Artificial Sequence: Synthetic oligonucleotide
ctttttatactttttttccg

SEQ ID NO: 4032 - DNA, 20 bp, Artificial Sequence
  Description of Artificial Sequence: Synthetic oligonucleotide
cttgtttgctttcttctccg

SEQ ID NO: 4033 - DNA, 20 bp, Artificial Sequence
  Description of Artificial Sequence: Synthetic oligonucleotide
tttgtttttgtgcttttccc

SEQ ID NO: 4034 - DNA, 20 bp, Artificial Sequence
  Description of Artificial Sequence: Synthetic oligonucleotide
atctttgttctctattaccg

SEQ ID NO: 4035 - DNA, 20 bp, Artificial Sequence
  Description of Artificial Sequence: Synthetic oligonucleotide
ctttctacttcttctcaccg

SEQ ID NO: 4036 - DNA, 20 bp, Artificial Sequence
  Description of Artificial Sequence: Synthetic oligonucleotide
ttcttttgcgcctttttccg

SEQ ID NO: 4037 - DNA, 20 bp, Artificial Sequence
  Description of Artificial Sequence: Synthetic oligonucleotide
atttattttcttttcagccg

SEQ ID NO: 4038 - DNA, 20 bp, Artificial Sequence
  Description of Artificial Sequence: Synthetic oligonucleotide
tttttcctattatgcttccg

SEQ ID NO: 4039 - DNA, 20 bp, Artificial Sequence
  Description of Artificial Sequence: Synthetic oligonucleotide
ttttttgtctatcttttccg

SEQ ID NO: 4040 - DNA, 20 bp, Artificial Sequence
  Description of Artificial Sequence: Synthetic oligonucleotide
ttctttcttttttccttccg

SEQ ID NO: 4041 - DNA, 20 bp, Artificial Sequence
  Description of Artificial Sequence: Synthetic oligonucleotide
ctttcattccttttttcccg

SEQ ID NO: 4042 - DNA, 21 bp, Artificial Sequence
  Description of Artificial Sequence: Synthetic oligonucleotide
tttcacactttttttttgctg

SEQ ID NO: 4043 - DNA, 20 bp, Artificial Sequence
  Description of Artificial Sequence: Synthetic oligonucleotide
attttttctagtttttgctg

SEQ ID NO: 4044 - DNA, 20 bp, Artificial Sequence
  Description of Artificial Sequence: Synthetic oligonucleotide
tttttcttttaacttttccg

SEQ ID NO: 4045 - DNA, 21 bp, Artificial Sequence
  Description of Artificial Sequence: Synthetic oligonucleotide
gttcttttatttgtttttccc

SEQ ID NO: 4046 - DNA, 20 bp, Artificial Sequence
  Description of Artificial Sequence: Synthetic oligonucleotide
ttatttaaatttttgttgtg

SEQ ID NO: 4047 - DNA, 21 bp, Artificial Sequence
  Description of Artificial Sequence: Synthetic oligonucleotide
tctgttgtgcttgatatgccc

SEQ ID NO: 4048 - DNA, 20 bp, Artificial Sequence
  Description of Artificial Sequence: Synthetic oligonucleotide
ttttcttgtttattccaccg

SEQ ID NO: 4049 - DNA, 20 bp, Artificial Sequence
  Description of Artificial Sequence: Synthetic oligonucleotide
tatacttttttcttccgccg

SEQ ID NO: 4050 - DNA, 20 bp, Artificial Sequence
  Description of Artificial Sequence: Synthetic oligonucleotide
tctttatcattctgtttccg

SEQ ID NO: 4051 - DNA, 20 bp, Artificial Sequence
  Description of Artificial Sequence: Synthetic oligonucleotide
gtcttttcttgttttctgcc

SEQ ID NO: 4052 - DNA, 20 bp, Artificial Sequence
  Description of Artificial Sequence: Synthetic oligonucleotide
tattttattctatccctccg

SEQ ID NO: 4053 - DNA, 20 bp, Artificial Sequence
  Description of Artificial Sequence: Synthetic oligonucleotide
ctctttaacctttctttccg

SEQ ID NO: 4054 - DNA, 20 bp, Artificial Sequence
  Description of Artificial Sequence: Synthetic oligonucleotide
tttccggttctttttttccg

SEQ ID NO: 4055 - DNA, 20 bp, Artificial Sequence
  Description of Artificial Sequence: Synthetic oligonucleotide
atttcttattccttaccccg

SEQ ID NO: 4056 - DNA, 20 bp, Artificial Sequence
  Description of Artificial Sequence: Synthetic oligonucleotide
acttctctttcctattaccg

SEQ ID NO: 4057 - DNA, 20 bp, Artificial Sequence
  Description of Artificial Sequence: Synthetic oligonucleotide
ctttctttctctttttcccg

SEQ ID NO: 4058 - DNA, 20 bp, Artificial Sequence
  Description of Artificial Sequence: Synthetic oligonucleotide
gtttacattttcttcttccg

SEQ ID NO: 4059 - DNA, 20 bp, Artificial Sequence
  Description of Artificial Sequence: Synthetic oligonucleotide
ctttttttcctttatttccg

SEQ ID NO: 4060 - DNA, 20 bp, Artificial Sequence
  Description of Artificial Sequence: Synthetic oligonucleotide
ttttttacgcctttttcccg

SEQ ID NO: 4061 - DNA, 20 bp, Artificial Sequence
  Description of Artificial Sequence: Synthetic oligonucleotide
ttatattacttttccttctg

SEQ ID NO: 4062 - DNA, 20 bp, Artificial Sequence
  Description of Artificial Sequence: Synthetic oligonucleotide
atccctttctttttcccccg

SEQ ID NO: 4063 - DNA, 20 bp, Artificial Sequence
  Description of Artificial Sequence: Synthetic oligonucleotide
aattttcttgtttgctgccc

SEQ ID NO: 4064 - DNA, 20 bp, Artificial Sequence
  Description of Artificial Sequence: Synthetic oligonucleotide
tttgggagtagggtgctccg

SEQ ID NO: 4065 - DNA, 20 bp, Artificial Sequence
  Description of Artificial Sequence: Synthetic oligonucleotide
ctttcttctgactttctccg

SEQ ID NO: 4066 - DNA, 20 bp, Artificial Sequence
  Description of Artificial Sequence: Synthetic oligonucleotide
tctgtttttcttcctttgcc

SEQ ID NO: 4067 - DNA, 20 bp, Artificial Sequence
  Description of Artificial Sequence: Synthetic oligonucleotide
atctttaatacttctctccg

SEQ ID NO: 4068 - DNA, 20 bp, Artificial Sequence
  Description of Artificial Sequence: Synthetic oligonucleotide
tttctatcttccttactccg

SEQ ID NO: 4069 - DNA, 20 bp, Artificial Sequence
  Description of Artificial Sequence: Synthetic oligonucleotide
tattttcttttttcgctgcc

SEQ ID NO: 4070 - DNA, 20 bp, Artificial Sequence
  Description of Artificial Sequence: Synthetic oligonucleotide
cttgctttttcatttttccg

SEQ ID NO: 4071 - DNA, 20 bp, Artificial Sequence
  Description of Artificial Sequence: Synthetic oligonucleotide
ttttttacattctctctctg

SEQ ID NO: 4072 - DNA, 20 bp, Artificial Sequence
  Description of Artificial Sequence: Synthetic oligonucleotide
cttttcatacgctttttccg

SEQ ID NO: 4073 - DNA, 20 bp, Artificial Sequence
  Description of Artificial Sequence: Synthetic oligonucleotide
gctattcttttctttttccc

SEQ ID NO: 4074 - DNA, 20 bp, Artificial Sequence
  Description of Artificial Sequence: Synthetic oligonucleotide
tttattttagtctcttcccg

SEQ ID NO: 4075 - DNA, 20 bp, Artificial Sequence
  Description of Artificial Sequence: Synthetic oligonucleotide
ttcatttttgttttctcccg

SEQ ID NO: 4076 - DNA, 21 bp, Artificial Sequence
  Description of Artificial Sequence: Synthetic oligonucleotide
tttacttttttacgctttccc

SEQ ID NO: 4077 - DNA, 20 bp, Artificial Sequence
  Description of Artificial Sequence: Synthetic oligonucleotide
gttttctaccttctttaccg

SEQ ID NO: 4078 - DNA, 19 bp, Artificial Sequence
  Description of Artificial Sequence: Synthetic oligonucleotide
tttggggtttcccgtgccg

SEQ ID NO: 4079 - DNA, 20 bp, Artificial Sequence
  Description of Artificial Sequence: Synthetic oligonucleotide
tttttacctttttccttccg

SEQ ID NO: 4080 - DNA, 20 bp, Artificial Sequence
  Description of Artificial Sequence: Synthetic oligonucleotide
ttcatcgctgtttttctccg

SEQ ID NO: 4081 - DNA, 21 bp, Artificial Sequence
  Description of Artificial Sequence: Synthetic oligonucleotide
acttttttttgtcttctgccg

SEQ ID NO: 4082 - DNA, 20 bp, Artificial Sequence
  Description of Artificial Sequence: Synthetic oligonucleotide
cgatttttcttcttttgcgc

SEQ ID NO: 4083 - DNA, 20 bp, Artificial Sequence
  Description of Artificial Sequence: Synthetic oligonucleotide
tcttttttcatttctcaccg

SEQ ID NO: 4084 - DNA, 20 bp, Artificial Sequence
  Description of Artificial Sequence: Synthetic oligonucleotide
attttttctcttatttgccg

SEQ ID NO: 4085 - DNA, 21 bp, Artificial Sequence
  Description of Artificial Sequence: Synthetic oligonucleotide
atttttccttgtcttataccg

SEQ ID NO: 4086 - DNA, 20 bp, Artificial Sequence
  Description of Artificial Sequence: Synthetic oligonucleotide
ttccttttaccttttcgccg

SEQ ID NO: 4087 - DNA, 20 bp, Artificial Sequence
  Description of Artificial Sequence: Synthetic oligonucleotide
cctttcttttctctactccg

SEQ ID NO: 4088 - DNA, 20 bp, Artificial Sequence
  Description of Artificial Sequence: Synthetic oligonucleotide
tttctactttttcttttccc

SEQ ID NO: 4089 - DNA, 20 bp, Artificial Sequence
  Description of Artificial Sequence: Synthetic oligonucleotide
tttttacccttttttgtccg

SEQ ID NO: 4090 - DNA, 20 bp, Artificial Sequence
  Description of Artificial Sequence: Synthetic oligonucleotide
cttgtttccttttttctccg

SEQ ID NO: 4091 - DNA, 20 bp, Artificial Sequence
  Description of Artificial Sequence: Synthetic oligonucleotide
tctttttttcattttttccg

SEQ ID NO: 4092 - DNA, 20 bp, Artificial Sequence
  Description of Artificial Sequence: Synthetic oligonucleotide
tcttattctttcttctccgc

SEQ ID NO: 4093 - DNA, 20 bp, Artificial Sequence
  Description of Artificial Sequence: Synthetic oligonucleotide
ttctttttaacttacttccg

SEQ ID NO: 4094 - DNA, 21 bp, Artificial Sequence
  Description of Artificial Sequence: Synthetic oligonucleotide
tttttctctttttttccgccg

SEQ ID NO: 4095 - DNA, 20 bp, Artificial Sequence
  Description of Artificial Sequence: Synthetic oligonucleotide
ttttttatttgttagttgtg

SEQ ID NO: 4096 - DNA, 20 bp, Artificial Sequence
  Description of Artificial Sequence: Synthetic oligonucleotide
tttttcacacattatttccg

SEQ ID NO: 4097 - DNA, 21 bp, Artificial Sequence
  Description of Artificial Sequence: Synthetic oligonucleotide
tttgtttattctttttttccg

SEQ ID NO: 4098 - DNA, 18 bp, Artificial Sequence
  Description of Artificial Sequence: Synthetic oligonucleotide
tcctgtcgtcttcgtccc

SEQ ID NO: 4099 - DNA, 20 bp, Artificial Sequence
  Description of Artificial Sequence: Synthetic oligonucleotide
tattttcttctctcggtccg

SEQ ID NO: 4100 - DNA, 20 bp, Artificial Sequence
  Description of Artificial Sequence: Synthetic oligonucleotide
atctcttctttcttaccccg

SEQ ID NO: 4101 - DNA, 20 bp, Artificial Sequence
  Description of Artificial Sequence: Synthetic oligonucleotide
tttctatttcctttgccccg

SEQ ID NO: 4102 - DNA, 20 bp, Artificial Sequence
  Description of Artificial Sequence: Synthetic oligonucleotide
tttatattttctcgcctccg

SEQ ID NO: 4103 - DNA, 20 bp, Artificial Sequence
  Description of Artificial Sequence: Synthetic oligonucleotide
gcttcttctttcttcatccg

SEQ ID NO: 4104 - DNA, 20 bp, Artificial Sequence
  Description of Artificial Sequence: Synthetic oligonucleotide
tatcttgttactttttcccc

SEQ ID NO: 4105 - DNA, 19 bp, Artificial Sequence
  Description of Artificial Sequence: Synthetic oligonucleotide
ccttgtcttttttcttccg

SEQ ID NO: 4106 - DNA, 20 bp, Artificial Sequence
  Description of Artificial Sequence: Synthetic oligonucleotide
tttctcttattctccttccg

SEQ ID NO: 4107 - DNA, 20 bp, Artificial Sequence
  Description of Artificial Sequence: Synthetic oligonucleotide
tagtgttttttttttgtgcc

SEQ ID NO: 4108 - DNA, 20 bp, Artificial Sequence
  Description of Artificial Sequence: Synthetic oligonucleotide
atttctatcgctttttcccg

SEQ ID NO: 4109 - DNA, 20 bp, Artificial Sequence
  Description of Artificial Sequence: Synthetic oligonucleotide
tcattttgtcttttattccg

SEQ ID NO: 4110 - DNA, 20 bp, Artificial Sequence
  Description of Artificial Sequence: Synthetic oligonucleotide
atctttctttctcttaccgc

SEQ ID NO: 4111 - DNA, 20 bp, Artificial Sequence
  Description of Artificial Sequence: Synthetic oligonucleotide
ctttctaatactcttctccg

SEQ ID NO: 4112 - DNA, 20 bp, Artificial Sequence
  Description of Artificial Sequence: Synthetic oligonucleotide
ttttctagctttcctttccg

SEQ ID NO: 4113 - DNA, 20 bp, Artificial Sequence
  Description of Artificial Sequence: Synthetic oligonucleotide
cttttattttgttttcaccg

SEQ ID NO: 4114 - DNA, 20 bp, Artificial Sequence
  Description of Artificial Sequence: Synthetic oligonucleotide
tttcactatcttttctcccg

SEQ ID NO: 4115 - DNA, 20 bp, Artificial Sequence
  Description of Artificial Sequence: Synthetic oligonucleotide
atccttttgttttcttaccg

SEQ ID NO: 4116 - DNA, 20 bp, Artificial Sequence
  Description of Artificial Sequence: Synthetic oligonucleotide
cctttttcatttttatcccg

SEQ ID NO: 4117 - DNA, 22 bp, Artificial Sequence
  Description of Artificial Sequence: Synthetic oligonucleotide
tttgttgttgtttttttttctg

SEQ ID NO: 4118 - DNA, 20 bp, Artificial Sequence
  Description of Artificial Sequence: Synthetic oligonucleotide
tttgggattttcccgtgccc

SEQ ID NO: 4119 - DNA, 20 bp, Artificial Sequence
  Description of Artificial Sequence: Synthetic oligonucleotide
ttttgtttgctttgtctccg

SEQ ID NO: 4120 - DNA, 20 bp, Artificial Sequence
  Description of Artificial Sequence: Synthetic oligonucleotide
attcattcttttttaccccg

SEQ ID NO: 4121 - DNA, 20 bp, Artificial Sequence
  Description of Artificial Sequence: Synthetic oligonucleotide
cttatttcttccggtttccg

SEQ ID NO: 4122 - DNA, 20 bp, Artificial Sequence
  Description of Artificial Sequence: Synthetic oligonucleotide
tatttcttttacttttgccc

SEQ ID NO: 4123 - DNA, 20 bp, Artificial Sequence
  Description of Artificial Sequence: Synthetic oligonucleotide
tttttccttttaactttccg

SEQ ID NO: 4124 - DNA, 20 bp, Artificial Sequence
  Description of Artificial Sequence: Synthetic oligonucleotide
ttcctttatttttctcgccg

SEQ ID NO: 4125 - DNA, 20 bp, Artificial Sequence
  Description of Artificial Sequence: Synthetic oligonucleotide
tatttttccactgttttccg

SEQ ID NO: 4126 - DNA, 20 bp, Artificial Sequence
  Description of Artificial Sequence: Synthetic oligonucleotide
cgttttacttattctttccg

SEQ ID NO: 4127 - DNA, 20 bp, Artificial Sequence
  Description of Artificial Sequence: Synthetic oligonucleotide
ttcacttctttattctcccg

SEQ ID NO: 4128 - DNA, 20 bp, Artificial Sequence
  Description of Artificial Sequence: Synthetic oligonucleotide
ttttttcatccttttgtctg

SEQ ID NO: 4129 - DNA, 20 bp, Artificial Sequence
  Description of Artificial Sequence: Synthetic oligonucleotide
tttcctacttttttcttccg

SEQ ID NO: 4130 - DNA, 20 bp, Artificial Sequence
  Description of Artificial Sequence: Synthetic oligonucleotide
acttttttattctttttccg

SEQ ID NO: 4131 - DNA, 20 bp, Artificial Sequence
  Description of Artificial Sequence: Synthetic oligonucleotide
ttattcttaattcttttccg

SEQ ID NO: 4132 - DNA, 20 bp, Artificial Sequence
  Description of Artificial Sequence: Synthetic oligonucleotide
tctttctctcctctttgccg

SEQ ID NO: 4133 - DNA, 20 bp, Artificial Sequence
  Description of Artificial Sequence: Synthetic oligonucleotide
atctctggtttctttctccg

SEQ ID NO: 4134 - DNA, 20 bp, Artificial Sequence
  Description of Artificial Sequence: Synthetic oligonucleotide
ttactgcttatttctctccg

SEQ ID NO: 4135 - DNA, 20 bp, Artificial Sequence
  Description of Artificial Sequence: Synthetic oligonucleotide
ttttcttttctgtttatccg

SEQ ID NO: 4136 - DNA, 20 bp, Artificial Sequence
  Description of Artificial Sequence: Synthetic oligonucleotide
ttctacttctttcttcaccg

SEQ ID NO: 4137 - DNA, 20 bp, Artificial Sequence
  Description of Artificial Sequence: Synthetic oligonucleotide
ctttttcgttttttccaccg

SEQ ID NO: 4138 - DNA, 20 bp, Artificial Sequence
  Description of Artificial Sequence: Synthetic oligonucleotide
ttgttctttcattttctccg

SEQ ID NO: 4139 - DNA, 20 bp, Artificial Sequence
  Description of Artificial Sequence: Synthetic oligonucleotide
cttttaattgttcccttccg

SEQ ID NO: 4140 - DNA, 20 bp, Artificial Sequence
  Description of Artificial Sequence: Synthetic oligonucleotide
actattttctgttttcaccg

SEQ ID NO: 4141 - DNA, 20 bp, Artificial Sequence
  Description of Artificial Sequence: Synthetic oligonucleotide
ccttatttacttttactccg

SEQ ID NO: 4142 - DNA, 21 bp, Artificial Sequence
  Description of Artificial Sequence: Synthetic oligonucleotide
tttttcaggtttttttcgcat

SEQ ID NO: 4143 - DNA, 21 bp, Artificial Sequence
  Description of Artificial Sequence: Synthetic oligonucleotide
tcctgtcgtcttgttcgtccc

SEQ ID NO: 4144 - DNA, 20 bp, Artificial Sequence
  Description of Artificial Sequence: Synthetic oligonucleotide
ttttatcaccttcttgtccg

SEQ ID NO: 4145 - DNA, 20 bp, Artificial Sequence
  Description of Artificial Sequence: Synthetic oligonucleotide
cttttacttgtcttttaccg

SEQ ID NO: 4146 - DNA, 20 bp, Artificial Sequence
  Description of Artificial Sequence: Synthetic oligonucleotide
ttatttctttattttcgctg

SEQ ID NO: 4147 - DNA, 20 bp, Artificial Sequence
  Description of Artificial Sequence: Synthetic oligonucleotide
tcttaatatgttcttctccg

SEQ ID NO: 4148 - DNA, 20 bp, Artificial Sequence
  Description of Artificial Sequence: Synthetic oligonucleotide
ctttcttttacttttcaccg

SEQ ID NO: 4149 - DNA, 21 bp, Artificial Sequence
  Description of Artificial Sequence: Synthetic oligonucleotide
tttttttcctatctctgtccg

SEQ ID NO: 4150 - DNA, 21 bp, Artificial Sequence
  Description of Artificial Sequence: Synthetic oligonucleotide
cttttccttttttttgttccg

SEQ ID NO: 4151 - DNA, 20 bp, Artificial Sequence
  Description of Artificial Sequence: Synthetic oligonucleotide
tttctcattttcattatccg

SEQ ID NO: 4152 - DNA, 20 bp, Artificial Sequence
  Description of Artificial Sequence: Synthetic oligonucleotide
ctctttattatttttccccg

SEQ ID NO: 4153 - DNA, 20 bp, Artificial Sequence
  Description of Artificial Sequence: Synthetic oligonucleotide
attctttcttattcttgctg

SEQ ID NO: 4154 - DNA, 20 bp, Artificial Sequence
  Description of Artificial Sequence: Synthetic oligonucleotide
ttctttgctatctttttccg

SEQ ID NO: 4155 - DNA, 20 bp, Artificial Sequence
  Description of Artificial Sequence: Synthetic oligonucleotide
cctttacctcttttattccg

SEQ ID NO: 4156 - DNA, 20 bp, Artificial Sequence
  Description of Artificial Sequence: Synthetic oligonucleotide
catttactttcttttcactg

SEQ ID NO: 4157 - DNA, 20 bp, Artificial Sequence
  Description of Artificial Sequence: Synthetic oligonucleotide
tcgtgtcgtctgttcgtccc

SEQ ID NO: 4158 - DNA, 20 bp, Artificial Sequence
  Description of Artificial Sequence: Synthetic oligonucleotide
ctattttctctgttcctccg

SEQ ID NO: 4159 - DNA, 20 bp, Artificial Sequence
  Description of Artificial Sequence: Synthetic oligonucleotide
ttgggtgtaggggggttccg

SEQ ID NO: 4160 - DNA, 20 bp, Artificial Sequence
  Description of Artificial Sequence: Synthetic oligonucleotide
ttttcactaccctttctccg

SEQ ID NO: 4161 - DNA, 20 bp, Artificial Sequence
  Description of Artificial Sequence: Synthetic oligonucleotide
ttgtttctcttatttcgccc

SEQ ID NO: 4162 - DNA, 20 bp, Artificial Sequence
  Description of Artificial Sequence: Synthetic oligonucleotide
tttaccttttcatctctccg

SEQ ID NO: 4163 - DNA, 20 bp, Artificial Sequence
  Description of Artificial Sequence: Synthetic oligonucleotide
tcttttatttcattcatccg

SEQ ID NO: 4164 - DNA, 20 bp, Artificial Sequence
  Description of Artificial Sequence: Synthetic oligonucleotide
tttttctcatcttatctccg

SEQ ID NO: 4165 - DNA, 20 bp, Artificial Sequence
  Description of Artificial Sequence: Synthetic oligonucleotide
ctctttactttatctttccg

SEQ ID NO: 4166 - DNA, 20 bp, Artificial Sequence
  Description of Artificial Sequence: Synthetic oligonucleotide
tttctttatttctctttgcg

SEQ ID NO: 4167 - DNA, 20 bp, Artificial Sequence
  Description of Artificial Sequence: Synthetic oligonucleotide
ctcttaatgctttctctccg

SEQ ID NO: 4168 - DNA, 20 bp, Artificial Sequence
  Description of Artificial Sequence: Synthetic oligonucleotide
tttacttctttatatctccg

SEQ ID NO: 4169 - DNA, 20 bp, Artificial Sequence
  Description of Artificial Sequence: Synthetic oligonucleotide
tttcatatttttcttctccg

SEQ ID NO: 4170 - DNA, 20 bp, Artificial Sequence
  Description of Artificial Sequence: Synthetic oligonucleotide
tattgctatctttttccccg

SEQ ID NO: 4171 - DNA, 21 bp, Artificial Sequence
  Description of Artificial Sequence: Synthetic oligonucleotide
tattttttttccttttctccg

SEQ ID NO: 4172 - DNA, 20 bp, Artificial Sequence
  Description of Artificial Sequence: Synthetic oligonucleotide
attttttcctatttctaccg

SEQ ID NO: 4173 - DNA, 21 bp, Artificial Sequence
  Description of Artificial Sequence: Synthetic oligonucleotide
ttattgttttatttttttgcc

SEQ ID NO: 4174 - DNA, 20 bp, Artificial Sequence
  Description of Artificial Sequence: Synthetic oligonucleotide
ctttctttttatactttccg

SEQ ID NO: 4175 - DNA, 20 bp, Artificial Sequence
  Description of Artificial Sequence: Synthetic oligonucleotide
tcctcgtcgtcttgcgtccc

SEQ ID NO: 4176 - DNA, 20 bp, Artificial Sequence
  Description of Artificial Sequence: Synthetic oligonucleotide
tctattcattctcttatccg

SEQ ID NO: 4177 - DNA, 20 bp, Artificial Sequence
  Description of Artificial Sequence: Synthetic oligonucleotide
aacttttcccttttccaccg

SEQ ID NO: 4178 - DNA, 20 bp, Artificial Sequence
  Description of Artificial Sequence: Synthetic oligonucleotide
tttcttcttgcttcttcccg

SEQ ID NO: 4179 - DNA, 20 bp, Artificial Sequence
  Description of Artificial Sequence: Synthetic oligonucleotide
ttttattctcgttttctccg

SEQ ID NO: 4180 - DNA, 20 bp, Artificial Sequence
  Description of Artificial Sequence: Synthetic oligonucleotide
tttttcctgttcttactccg

SEQ ID NO: 4181 - DNA, 20 bp, Artificial Sequence
  Description of Artificial Sequence: Synthetic oligonucleotide
ctttcttatgctctttaccg

SEQ ID NO: 4182 - DNA, 20 bp, Artificial Sequence
  Description of Artificial Sequence: Synthetic oligonucleotide
ttttttcctttcactatccg

SEQ ID NO: 4183 - DNA, 19 bp, Artificial Sequence
  Description of Artificial Sequence: Synthetic oligonucleotide
ttcgtactttttttttccg

SEQ ID NO: 4184 - DNA, 20 bp, Artificial Sequence
  Description of Artificial Sequence: Synthetic oligonucleotide
aatcatttcttcttccaccg

SEQ ID NO: 4185 - DNA, 20 bp, Artificial Sequence
  Description of Artificial Sequence: Synthetic oligonucleotide
tttttcactttcacttgctg

SEQ ID NO: 4186 - DNA, 20 bp, Artificial Sequence
  Description of Artificial Sequence: Synthetic oligonucleotide
tttatttacttttccctcgc

SEQ ID NO: 4187 - DNA, 20 bp, Artificial Sequence
  Description of Artificial Sequence: Synthetic oligonucleotide
ctttacattatctctttccg

SEQ ID NO: 4188 - DNA, 20 bp, Artificial Sequence
  Description of Artificial Sequence: Synthetic oligonucleotide
tctctttaaaattctctccg

SEQ ID NO: 4189 - DNA, 20 bp, Artificial Sequence
  Description of Artificial Sequence: Synthetic oligonucleotide
tctttcttttaccctatccg

SEQ ID NO: 4190 - DNA, 20 bp, Artificial Sequence
  Description of Artificial Sequence: Synthetic oligonucleotide
gttttatttgttgtgttccc

SEQ ID NO: 4191 - DNA, 20 bp, Artificial Sequence
  Description of Artificial Sequence: Synthetic oligonucleotide
cctttatttcttattctccg

SEQ ID NO: 4192 - DNA, 20 bp, Artificial Sequence
  Description of Artificial Sequence: Synthetic oligonucleotide
cttttttctttttcattccg

SEQ ID NO: 4193 - DNA, 20 bp, Artificial Sequence
  Description of Artificial Sequence: Synthetic oligonucleotide
tcttattcttttttcctctg

SEQ ID NO: 4194 - DNA, 20 bp, Artificial Sequence
  Description of Artificial Sequence: Synthetic oligonucleotide
atcttttctgtcttttcccg

SEQ ID NO: 4195 - DNA, 20 bp, Artificial Sequence
  Description of Artificial Sequence: Synthetic oligonucleotide
tttgttgtgttctttatccg

SEQ ID NO: 4196 - DNA, 20 bp, Artificial Sequence
  Description of Artificial Sequence: Synthetic oligonucleotide
tttgtccttgtttttgtccg

SEQ ID NO: 4197 - DNA, 20 bp, Artificial Sequence
  Description of Artificial Sequence: Synthetic oligonucleotide
tatttttgctttcctgtccg

SEQ ID NO: 4198 - DNA, 20 bp, Artificial Sequence
  Description of Artificial Sequence: Synthetic oligonucleotide
ttttgcttatcttctgtccg

SEQ ID NO: 4199 - DNA, 20 bp, Artificial Sequence
  Description of Artificial Sequence: Synthetic oligonucleotide
gatacttttttttttgcccc

SEQ ID NO: 4200 - DNA, 20 bp, Artificial Sequence
  Description of Artificial Sequence: Synthetic oligonucleotide
cctactttgtctcttttccg

SEQ ID NO: 4201 - DNA, 20 bp, Artificial Sequence
  Description of Artificial Sequence: Synthetic oligonucleotide
gttttttgatctcttgtccc

SEQ ID NO: 4202 - DNA, 20 bp, Artificial Sequence
  Description of Artificial Sequence: Synthetic oligonucleotide
tcttctttttctgttctccg

SEQ ID NO: 4203 - DNA, 21 bp, Artificial Sequence
  Description of Artificial Sequence: Synthetic oligonucleotide
gtttttatttccactgttccc

SEQ ID NO: 4204 - DNA, 20 bp, Artificial Sequence
  Description of Artificial Sequence: Synthetic oligonucleotide
tttattttactgtttctccg

SEQ ID NO: 4205 - DNA, 20 bp, Artificial Sequence
  Description of Artificial Sequence: Synthetic oligonucleotide
tttggttttttttttgcccg

SEQ ID NO: 4206 - DNA, 21 bp, Artificial Sequence
  Description of Artificial Sequence: Synthetic oligonucleotide
tttccacggtttttttttccg

SEQ ID NO: 4207 - DNA, 20 bp, Artificial Sequence
  Description of Artificial Sequence: Synthetic oligonucleotide
atttcttctcttatttcccg

SEQ ID NO: 4208 - DNA, 20 bp, Artificial Sequence
  Description of Artificial Sequence: Synthetic oligonucleotide
tattttgatttacttttccc

SEQ ID NO: 4209 - DNA, 20 bp, Artificial Sequence
  Description of Artificial Sequence: Synthetic oligonucleotide
gttctttcatgttttttccc

SEQ ID NO: 4210 - DNA, 20 bp, Artificial Sequence
  Description of Artificial Sequence: Synthetic oligonucleotide
gtttgttctttttttttccg

SEQ ID NO: 4211 - DNA, 20 bp, Artificial Sequence
  Description of Artificial Sequence: Synthetic oligonucleotide
tatttacgtttttttttgtg

SEQ ID NO: 4212 - DNA, 20 bp, Artificial Sequence
  Description of Artificial Sequence: Synthetic oligonucleotide
aaggaggtggtgttatggtg

SEQ ID NO: 4213 - DNA, 20 bp, Artificial Sequence
  Description of Artificial Sequence: Synthetic oligonucleotide
ttatcacctttcttcttccg

SEQ ID NO: 4214 - DNA, 20 bp, Artificial Sequence
  Description of Artificial Sequence: Synthetic oligonucleotide
ttttcttggtcttcttgccg

SEQ ID NO: 4215 - DNA, 20 bp, Artificial Sequence
  Description of Artificial Sequence: Synthetic oligonucleotide
tgcttctttttctttccccg

SEQ ID NO: 4216 - DNA, 20 bp, Artificial Sequence
  Description of Artificial Sequence: Synthetic oligonucleotide
ttttcatttctcttttaccc

SEQ ID NO: 4217 - DNA, 20 bp, Artificial Sequence
  Description of Artificial Sequence: Synthetic oligonucleotide
cttctcgtcttttcttaccg

SEQ ID NO: 4218 - DNA, 20 bp, Artificial Sequence
  Description of Artificial Sequence: Synthetic oligonucleotide
tttttcagtgtttttgtgtg

SEQ ID NO: 4219 - DNA, 20 bp, Artificial Sequence
  Description of Artificial Sequence: Synthetic oligonucleotide
gtttactttttcccttttcc

SEQ ID NO: 4220 - DNA, 20 bp, Artificial Sequence
  Description of Artificial Sequence: Synthetic oligonucleotide
cttctcttacttttcttccg

SEQ ID NO: 4221 - DNA, 20 bp, Artificial Sequence
  Description of Artificial Sequence: Synthetic oligonucleotide
cttttgtttcttctttcccg

SEQ ID NO: 4222 - DNA, 20 bp, Artificial Sequence
  Description of Artificial Sequence: Synthetic oligonucleotide
ttttcttttcttgttttgcg

SEQ ID NO: 4223 - DNA, 20 bp, Artificial Sequence
  Description of Artificial Sequence: Synthetic oligonucleotide
attttattttgtctttaccg

SEQ ID NO: 4224 - DNA, 20 bp, Artificial Sequence
  Description of Artificial Sequence: Synthetic oligonucleotide
tttttgcttctttttttgcg

SEQ ID NO: 4225 - DNA, 20 bp, Artificial Sequence
  Description of Artificial Sequence: Synthetic oligonucleotide
tattatcttttattcttgtg

SEQ ID NO: 4226 - DNA, 19 bp, Artificial Sequence
  Description of Artificial Sequence: Synthetic oligonucleotide
attctctttcttttcaccg

SEQ ID NO: 4227 - DNA, 20 bp, Artificial Sequence
  Description of Artificial Sequence: Synthetic oligonucleotide
tactttcccctttttctccg

SEQ ID NO: 4228 - DNA, 20 bp, Artificial Sequence
  Description of Artificial Sequence: Synthetic oligonucleotide
agtttcgtgtttttttgccc

SEQ ID NO: 4229 - DNA, 20 bp, Artificial Sequence
  Description of Artificial Sequence: Synthetic oligonucleotide
ttattcttcgcctttctccg

SEQ ID NO: 4230 - DNA, 20 bp, Artificial Sequence
  Description of Artificial Sequence: Synthetic oligonucleotide
tttattccactttcttcccg

SEQ ID NO: 4231 - DNA, 20 bp, Artificial Sequence
  Description of Artificial Sequence: Synthetic oligonucleotide
tttgggtgtagggtgttccg

SEQ ID NO: 4232 - DNA, 21 bp, Artificial Sequence
  Description of Artificial Sequence: Synthetic oligonucleotide
cttttctctttttttccgcgc

SEQ ID NO: 4233 - DNA, 20 bp, Artificial Sequence
  Description of Artificial Sequence: Synthetic oligonucleotide
atttttgctctttccttccg

SEQ ID NO: 4234 - DNA, 20 bp, Artificial Sequence
  Description of Artificial Sequence: Synthetic oligonucleotide
ctttctttatttcccttccg

SEQ ID NO: 4235 - DNA, 20 bp, Artificial Sequence
  Description of Artificial Sequence: Synthetic oligonucleotide
tactttcgcttttctttccg

SEQ ID NO: 4236 - DNA, 20 bp, Artificial Sequence
  Description of Artificial Sequence: Synthetic oligonucleotide
ccttttcgtttccttatccg

SEQ ID NO: 4237 - DNA, 20 bp, Artificial Sequence
  Description of Artificial Sequence: Synthetic oligonucleotide
tttttatacgttttgctccg

SEQ ID NO: 4238 - DNA, 20 bp, Artificial Sequence
  Description of Artificial Sequence: Synthetic oligonucleotide
tttcactgcttccttttccg

SEQ ID NO: 4239 - DNA, 20 bp, Artificial Sequence
  Description of Artificial Sequence: Synthetic oligonucleotide
gtttgcttttctcttttccg

SEQ ID NO: 4240 - DNA, 20 bp, Artificial Sequence
  Description of Artificial Sequence: Synthetic oligonucleotide
cctttactcattcttttccg

SEQ ID NO: 4241 - DNA, 21 bp, Artificial Sequence
  Description of Artificial Sequence: Synthetic oligonucleotide
ttttcattgtttcattttctg

SEQ ID NO: 4242 - DNA, 20 bp, Artificial Sequence
  Description of Artificial Sequence: Synthetic oligonucleotide
tctttttttgtgtttctccg

SEQ ID NO: 4243 - DNA, 20 bp, Artificial Sequence
  Description of Artificial Sequence: Synthetic oligonucleotide
ttgttttattttatttgccc

SEQ ID NO: 4244 - DNA, 21 bp, Artificial Sequence
  Description of Artificial Sequence: Synthetic oligonucleotide
ttaccttttgatttttttccc

SEQ ID NO: 4245 - DNA, 20 bp, Artificial Sequence
  Description of Artificial Sequence: Synthetic oligonucleotide
gttaccttttcctttttccc

SEQ ID NO: 4246 - DNA, 20 bp, Artificial Sequence
  Description of Artificial Sequence: Synthetic oligonucleotide
gttttctcattctcttaccg

SEQ ID NO: 4247 - DNA, 20 bp, Artificial Sequence
  Description of Artificial Sequence: Synthetic oligonucleotide
attttcctctttacttgccg

SEQ ID NO: 4248 - DNA, 20 bp, Artificial Sequence
  Description of Artificial Sequence: Synthetic oligonucleotide
atttttcttctcttaccccg

SEQ ID NO: 4249 - DNA, 20 bp, Artificial Sequence
  Description of Artificial Sequence: Synthetic oligonucleotide
ccttttacttccttttcccg

SEQ ID NO: 4250 - DNA, 20 bp, Artificial Sequence
  Description of Artificial Sequence: Synthetic oligonucleotide
aattttattttgttgtaccg

SEQ ID NO: 4251 - DNA, 20 bp, Artificial Sequence
  Description of Artificial Sequence: Synthetic oligonucleotide
ttctttgactatttactccg

SEQ ID NO: 4252 - DNA, 21 bp, Artificial Sequence
  Description of Artificial Sequence: Synthetic oligonucleotide
ttttcgtttttttttgcgccg

SEQ ID NO: 4253 - DNA, 19 bp, Artificial Sequence
  Description of Artificial Sequence: Synthetic oligonucleotide
tttttctttcctttgtccg

SEQ ID NO: 4254 - DNA, 20 bp, Artificial Sequence
  Description of Artificial Sequence: Synthetic oligonucleotide
atgttttcttcattttaccg

SEQ ID NO: 4255 - DNA, 20 bp, Artificial Sequence
  Description of Artificial Sequence: Synthetic oligonucleotide
ctattcaacttctttttccg

SEQ ID NO: 4256 - DNA, 19 bp, Artificial Sequence
  Description of Artificial Sequence: Synthetic oligonucleotide
tttgtttattctttttccg

SEQ ID NO: 4257 - DNA, 20 bp, Artificial Sequence
  Description of Artificial Sequence: Synthetic oligonucleotide
tttctttgtgtttttatccc

SEQ ID NO: 4258 - DNA, 20 bp, Artificial Sequence
  Description of Artificial Sequence: Synthetic oligonucleotide
atttcactactactttaccg

SEQ ID NO: 4259 - DNA, 20 bp, Artificial Sequence
  Description of Artificial Sequence: Synthetic oligonucleotide
ttttctttgtttctcgcccg

SEQ ID NO: 4260 - DNA, 20 bp, Artificial Sequence
  Description of Artificial Sequence: Synthetic oligonucleotide
ttcgtacttttttttttccg

SEQ ID NO: 4261 - DNA, 21 bp, Artificial Sequence
  Description of Artificial Sequence: Synthetic oligonucleotide
aatttctcgttttttttgctg

SEQ ID NO: 4262 - DNA, 20 bp, Artificial Sequence
  Description of Artificial Sequence: Synthetic oligonucleotide
ttatcttttactctattccg

SEQ ID NO: 4263 - DNA, 21 bp, Artificial Sequence
  Description of Artificial Sequence: Synthetic oligonucleotide
ttttagcttcttttttgtccg

SEQ ID NO: 4264 - DNA, 22 bp, Artificial Sequence
  Description of Artificial Sequence: Synthetic oligonucleotide
gttttgttttttttcctttccg

SEQ ID NO: 4265 - DNA, 20 bp, Artificial Sequence
  Description of Artificial Sequence: Synthetic oligonucleotide
ttttttctaatttctccccg

SEQ ID NO: 4266 - DNA, 20 bp, Artificial Sequence
  Description of Artificial Sequence: Synthetic oligonucleotide
agttctttattttctttccc

SEQ ID NO: 4267 - DNA, 20 bp, Artificial Sequence
  Description of Artificial Sequence: Synthetic oligonucleotide
ccttatttattttccttccg

SEQ ID NO: 4268 - DNA, 20 bp, Artificial Sequence
  Description of Artificial Sequence: Synthetic oligonucleotide
ttcggggttttcccgtgccc

SEQ ID NO: 4269 - DNA, 18 bp, Artificial Sequence
  Description of Artificial Sequence: Synthetic oligonucleotide
tcctcgtctgttcgtccc

SEQ ID NO: 4270 - DNA, 20 bp, Artificial Sequence
  Description of Artificial Sequence: Synthetic oligonucleotide
ttaggtgaagggtggttccg

SEQ ID NO: 4271 - DNA, 20 bp, Artificial Sequence
  Description of Artificial Sequence: Synthetic oligonucleotide
attctttatatcccttaccg

SEQ ID NO: 4272 - DNA, 20 bp, Artificial Sequence
  Description of Artificial Sequence: Synthetic oligonucleotide
gctctattccttcttttccg

SEQ ID NO: 4273 - DNA, 20 bp, Artificial Sequence
  Description of Artificial Sequence: Synthetic oligonucleotide
tttctatgtcgttttgtccg

SEQ ID NO: 4274 - DNA, 20 bp, Artificial Sequence
  Description of Artificial Sequence: Synthetic oligonucleotide
gttactcttttccgcttccg

SEQ ID NO: 4275 - DNA, 20 bp, Artificial Sequence
  Description of Artificial Sequence: Synthetic oligonucleotide
atgcttggagtaggggggtg

SEQ ID NO: 4276 - DNA, 20 bp, Artificial Sequence
  Description of Artificial Sequence: Synthetic oligonucleotide
ttatttctccttcgcttccg

SEQ ID NO: 4277 - DNA, 20 bp, Artificial Sequence
  Description of Artificial Sequence: Synthetic oligonucleotide
tttcttttcacctttacccg

SEQ ID NO: 4278 - DNA, 20 bp, Artificial Sequence
  Description of Artificial Sequence: Synthetic oligonucleotide
tttactctagcttttctccg

SEQ ID NO: 4279 - DNA, 19 bp, Artificial Sequence
  Description of Artificial Sequence: Synthetic oligonucleotide
gttttctctcttctttgcc

SEQ ID NO: 4280 - DNA, 20 bp, Artificial Sequence
  Description of Artificial Sequence: Synthetic oligonucleotide
agcttttctctttctttccg

SEQ ID NO: 4281 - DNA, 20 bp, Artificial Sequence
  Description of Artificial Sequence: Synthetic oligonucleotide
ctttaaacttttcttttccg

SEQ ID NO: 4282 - DNA, 20 bp, Artificial Sequence
  Description of Artificial Sequence: Synthetic oligonucleotide
cctattattcattttctccg

SEQ ID NO: 4283 - DNA, 20 bp, Artificial Sequence
  Description of Artificial Sequence: Synthetic oligonucleotide
ctcacttctttcttattccg

SEQ ID NO: 4284 - DNA, 20 bp, Artificial Sequence
  Description of Artificial Sequence: Synthetic oligonucleotide
atctttcattcttcttcccg

SEQ ID NO: 4285 - DNA, 20 bp, Artificial Sequence
  Description of Artificial Sequence: Synthetic oligonucleotide
ttatttatttgttctttgcc

SEQ ID NO: 4286 - DNA, 20 bp, Artificial Sequence
  Description of Artificial Sequence: Synthetic oligonucleotide
ttttactttcttactttgcc

SEQ ID NO: 4287 - DNA, 20 bp, Artificial Sequence
  Description of Artificial Sequence: Synthetic oligonucleotide
tttatttttgactttttccg

SEQ ID NO: 4288 - DNA, 20 bp, Artificial Sequence
  Description of Artificial Sequence: Synthetic oligonucleotide
ttctattttttcttcttccg

SEQ ID NO: 4289 - DNA, 20 bp, Artificial Sequence
  Description of Artificial Sequence: Synthetic oligonucleotide
ttttatttcttctttttcgc

SEQ ID NO: 4290 - DNA, 20 bp, Artificial Sequence
  Description of Artificial Sequence: Synthetic oligonucleotide
ttgtttattttctctttgcg

SEQ ID NO: 4291 - DNA, 20 bp, Artificial Sequence
  Description of Artificial Sequence: Synthetic oligonucleotide
gatctcttttcctctacccg

SEQ ID NO: 4292 - DNA, 20 bp, Artificial Sequence
  Description of Artificial Sequence: Synthetic oligonucleotide
attttctctcttctgccccg

SEQ ID NO: 4293 - DNA, 20 bp, Artificial Sequence
  Description of Artificial Sequence: Synthetic oligonucleotide
agtggagaagggaggtgctg

SEQ ID NO: 4294 - DNA, 18 bp, Artificial Sequence
  Description of Artificial Sequence: Synthetic oligonucleotide
ttcttgtctttctttccg

SEQ ID NO: 4295 - DNA, 19 bp, Artificial Sequence
  Description of Artificial Sequence: Synthetic oligonucleotide
tagtgtttttttttgtgcc

SEQ ID NO: 4296 - DNA, 20 bp, Artificial Sequence
  Description of Artificial Sequence: Synthetic oligonucleotide
tctttacgctttcttctccg

SEQ ID NO: 4297 - DNA, 20 bp, Artificial Sequence
  Description of Artificial Sequence: Synthetic oligonucleotide
tttttcatgaaccctttccg

SEQ ID NO: 4298 - DNA, 20 bp, Artificial Sequence
  Description of Artificial Sequence: Synthetic oligonucleotide
actctttatcgttttttccg

SEQ ID NO: 4299 - DNA, 20 bp, Artificial Sequence
  Description of Artificial Sequence: Synthetic oligonucleotide
cctttttttcttttccaccg

SEQ ID NO: 4300 - DNA, 20 bp, Artificial Sequence
  Description of Artificial Sequence: Synthetic oligonucleotide
tttttgtcgctttattcccg

SEQ ID NO: 4301 - DNA, 20 bp, Artificial Sequence
  Description of Artificial Sequence: Synthetic oligonucleotide
ttttttcacttttccctctg

SEQ ID NO: 4302 - DNA, 20 bp, Artificial Sequence
  Description of Artificial Sequence: Synthetic oligonucleotide
ttactctttctatttccccc

SEQ ID NO: 4303 - DNA, 20 bp, Artificial Sequence
  Description of Artificial Sequence: Synthetic oligonucleotide
atttttatgtgttgtttgtg

SEQ ID NO: 4304 - DNA, 20 bp, Artificial Sequence
  Description of Artificial Sequence: Synthetic oligonucleotide
attcttaatttctttgcccg

SEQ ID NO: 4305 - DNA, 20 bp, Artificial Sequence
  Description of Artificial Sequence: Synthetic oligonucleotide
tctattttatttgctttccg

SEQ ID NO: 4306 - DNA, 20 bp, Artificial Sequence
  Description of Artificial Sequence: Synthetic oligonucleotide
ttttctttcatcctggtccg

SEQ ID NO: 4307 - DNA, 20 bp, Artificial Sequence
  Description of Artificial Sequence: Synthetic oligonucleotide
accttttgttttctattccg

SEQ ID NO: 4308 - DNA, 20 bp, Artificial Sequence
  Description of Artificial Sequence: Synthetic oligonucleotide
attttgctctttttcttccg

SEQ ID NO: 4309 - DNA, 20 bp, Artificial Sequence
  Description of Artificial Sequence: Synthetic oligonucleotide
tttttgtctactttttccgc

SEQ ID NO: 4310 - DNA, 20 bp, Artificial Sequence
  Description of Artificial Sequence: Synthetic oligonucleotide
atctttctaaattttcaccg

SEQ ID NO: 4311 - DNA, 20 bp, Artificial Sequence
  Description of Artificial Sequence: Synthetic oligonucleotide
tcttttttcctatttctccg

SEQ ID NO: 4312 - DNA, 20 bp, Artificial Sequence
  Description of Artificial Sequence: Synthetic oligonucleotide
ttttcattatctttttccgc

SEQ ID NO: 4313 - DNA, 21 bp, Artificial Sequence
  Description of Artificial Sequence: Synthetic oligonucleotide
tttgtttttctttttttcgcc

SEQ ID NO: 4314 - DNA, 21 bp, Artificial Sequence
  Description of Artificial Sequence: Synthetic oligonucleotide
tccatgttgtttttttttccg

SEQ ID NO: 4315 - DNA, 21 bp, Artificial Sequence
  Description of Artificial Sequence: Synthetic oligonucleotide
tatttacgttttttttttgtg

SEQ ID NO: 4316 - DNA, 21 bp, Artificial Sequence
  Description of Artificial Sequence: Synthetic oligonucleotide
tcttttttttcactttctccg

SEQ ID NO: 4317 - DNA, 20 bp, Artificial Sequence
  Description of Artificial Sequence: Synthetic oligonucleotide
tttcctttttatcttttccc

SEQ ID NO: 4318 - DNA, 20 bp, Artificial Sequence
  Description of Artificial Sequence: Synthetic oligonucleotide
tttttatgtttttttccgtg

SEQ ID NO: 4319 - DNA, 20 bp, Artificial Sequence
  Description of Artificial Sequence: Synthetic oligonucleotide
tgttatttttgtttcttgtc

SEQ ID NO: 4320 - DNA, 21 bp, Artificial Sequence
  Description of Artificial Sequence: Synthetic oligonucleotide
catcactttttctttacaccg

SEQ ID NO: 4321 - DNA, 20 bp, Artificial Sequence
  Description of Artificial Sequence: Synthetic oligonucleotide
atctttttgttcgctttccg

SEQ ID NO: 4322 - DNA, 20 bp, Artificial Sequence
  Description of Artificial Sequence: Synthetic oligonucleotide
cctttcttcttttccttgcc

SEQ ID NO: 4323 - DNA, 20 bp, Artificial Sequence
  Description of Artificial Sequence: Synthetic oligonucleotide
atttgttccattttccaccg

SEQ ID NO: 4324 - DNA, 20 bp, Artificial Sequence
  Description of Artificial Sequence: Synthetic oligonucleotide
tactcttctttttatcgccg

SEQ ID NO: 4325 - DNA, 20 bp, Artificial Sequence
  Description of Artificial Sequence: Synthetic oligonucleotide
atcctgtcttattttctccg

SEQ ID NO: 4326 - DNA, 20 bp, Artificial Sequence
  Description of Artificial Sequence: Synthetic oligonucleotide
ttttcacattatttccccgc

SEQ ID NO: 4327 - DNA, 21 bp, Artificial Sequence
  Description of Artificial Sequence: Synthetic oligonucleotide
ctttttttcccttgttgttgc

SEQ ID NO: 4328 - DNA, 20 bp, Artificial Sequence
  Description of Artificial Sequence: Synthetic oligonucleotide
tctttactcatatttttccg

SEQ ID NO: 4329 - DNA, 20 bp, Artificial Sequence
  Description of Artificial Sequence: Synthetic oligonucleotide
ttctttgtttacctttcccg

SEQ ID NO: 4330 - DNA, 20 bp, Artificial Sequence
  Description of Artificial Sequence: Synthetic oligonucleotide
ttttttcctttatttttgcc

SEQ ID NO: 4331 - DNA, 20 bp, Artificial Sequence
  Description of Artificial Sequence: Synthetic oligonucleotide
ttaggtgaagggtggtttcg

SEQ ID NO: 4332 - DNA, 20 bp, Artificial Sequence
  Description of Artificial Sequence: Synthetic oligonucleotide
actttttctttttttccctg

SEQ ID NO: 4333 - DNA, 20 bp, Artificial Sequence
  Description of Artificial Sequence: Synthetic oligonucleotide
ttttttacttctcttcgctg

SEQ ID NO: 4334 - DNA, 20 bp, Artificial Sequence
  Description of Artificial Sequence: Synthetic oligonucleotide
ttatttactttttttctctg

SEQ ID NO: 4335 - DNA, 21 bp, Artificial Sequence
  Description of Artificial Sequence: Synthetic oligonucleotide
tttattctgtttttttttccg

SEQ ID NO: 4336 - DNA, 20 bp, Artificial Sequence
  Description of Artificial Sequence: Synthetic oligonucleotide
cttttctatacatttttccg

SEQ ID NO: 4337 - DNA, 20 bp, Artificial Sequence
  Description of Artificial Sequence: Synthetic oligonucleotide
ttatcttacgtttttctctg

SEQ ID NO: 4338 - DNA, 20 bp, Artificial Sequence
  Description of Artificial Sequence: Synthetic oligonucleotide
tttgtgttttttattttctg

SEQ ID NO: 4339 - DNA, 20 bp, Artificial Sequence
  Description of Artificial Sequence: Synthetic oligonucleotide
acacttttcttttctttccc

SEQ ID NO: 4340 - DNA, 20 bp, Artificial Sequence
  Description of Artificial Sequence: Synthetic oligonucleotide
cttttatgtttcccgttccg

SEQ ID NO: 4341 - DNA, 21 bp, Artificial Sequence
  Description of Artificial Sequence: Synthetic oligonucleotide
attttttgactgtttcctccg

SEQ ID NO: 4342 - DNA, 19 bp, Artificial Sequence
  Description of Artificial Sequence: Synthetic oligonucleotide
ttcttttctttcttctccg

SEQ ID NO: 4343 - DNA, 20 bp, Artificial Sequence
  Description of Artificial Sequence: Synthetic oligonucleotide
acttctattgctcctttccg

SEQ ID NO: 4344 - DNA, 19 bp, Artificial Sequence
  Description of Artificial Sequence: Synthetic oligonucleotide
gtttgtttctttgttaccg

SEQ ID NO: 4345 - DNA, 20 bp, Artificial Sequence
  Description of Artificial Sequence: Synthetic oligonucleotide
actttcacttactctcaccg

SEQ ID NO: 4346 - DNA, 20 bp, Artificial Sequence
  Description of Artificial Sequence: Synthetic oligonucleotide
gaattatcctgcattcaccg

SEQ ID NO: 4347 - DNA, 20 bp, Artificial Sequence
  Description of Artificial Sequence: Synthetic oligonucleotide
tgctttggagtaggggggtg

SEQ ID NO: 4348 - DNA, 20 bp, Artificial Sequence
  Description of Artificial Sequence: Synthetic oligonucleotide
ttatttttgtttctcttccg

SEQ ID NO: 4349 - DNA, 20 bp, Artificial Sequence
  Description of Artificial Sequence: Synthetic oligonucleotide
atttcaatttgctttcaccg

SEQ ID NO: 4350 - DNA, 20 bp, Artificial Sequence
  Description of Artificial Sequence: Synthetic oligonucleotide
ttcttttctctttaactccg

SEQ ID NO: 4351 - DNA, 20 bp, Artificial Sequence
  Description of Artificial Sequence: Synthetic oligonucleotide
cattcttttctttttcgctg

SEQ ID NO: 4352 - DNA, 20 bp, Artificial Sequence
  Description of Artificial Sequence: Synthetic oligonucleotide
ttattactttattctgtccg

SEQ ID NO: 4353 - DNA, 21 bp, Artificial Sequence
  Description of Artificial Sequence: Synthetic oligonucleotide
catatcttttcattttcaccg

SEQ ID NO: 4354 - DNA, 20 bp, Artificial Sequence
  Description of Artificial Sequence: Synthetic oligonucleotide
tttttcatacctttattccg

SEQ ID NO: 4355 - DNA, 19 bp, Artificial Sequence
  Description of Artificial Sequence: Synthetic oligonucleotide
tttcatctttttttttccg

SEQ ID NO: 4356 - DNA, 20 bp, Artificial Sequence
  Description of Artificial Sequence: Synthetic oligonucleotide
tttttgtcttttttctgcac

SEQ ID NO: 4357 - DNA, 20 bp, Artificial Sequence
  Description of Artificial Sequence: Synthetic oligonucleotide
attttatcgcttctttgccg

SEQ ID NO: 4358 - DNA, 20 bp, Artificial Sequence
  Description of Artificial Sequence: Synthetic oligonucleotide
acttcttttcttcttaaccg

SEQ ID NO: 4359 - DNA, 19 bp, Artificial Sequence
  Description of Artificial Sequence: Synthetic oligonucleotide
tttctttcatttttttccg

SEQ ID NO: 4360 - DNA, 20 bp, Artificial Sequence
  Description of Artificial Sequence: Synthetic oligonucleotide
accgtttctttttcttgccg

SEQ ID NO: 4361 - DNA, 19 bp, Artificial Sequence
  Description of Artificial Sequence: Synthetic oligonucleotide
tcctgtcgctgttcgtccc

SEQ ID NO: 4362 - DNA, 20 bp, Artificial Sequence
  Description of Artificial Sequence: Synthetic oligonucleotide
atctcttctttttccccccg

SEQ ID NO: 4363 - DNA, 20 bp, Artificial Sequence
  Description of Artificial Sequence: Synthetic oligonucleotide
cctttttactatcctctccg

SEQ ID NO: 4364 - DNA, 19 bp, Artificial Sequence
  Description of Artificial Sequence: Synthetic oligonucleotide
ttttattctttccgctccg

SEQ ID NO: 4365 - DNA, 20 bp, Artificial Sequence
  Description of Artificial Sequence: Synthetic oligonucleotide
ttttcactttcctacttccg

SEQ ID NO: 4366 - DNA, 20 bp, Artificial Sequence
  Description of Artificial Sequence: Synthetic oligonucleotide
ctcacttgctcttttctccg

SEQ ID NO: 4367 - DNA, 21 bp, Artificial Sequence
  Description of Artificial Sequence: Synthetic oligonucleotide
tatcttctctactctactccg

SEQ ID NO: 4368 - DNA, 20 bp, Artificial Sequence
  Description of Artificial Sequence: Synthetic oligonucleotide
actttccattacttttcccg

SEQ ID NO: 4369 - DNA, 20 bp, Artificial Sequence
  Description of Artificial Sequence: Synthetic oligonucleotide
cctttacttgtttttcaccg

SEQ ID NO: 4370 - DNA, 20 bp, Artificial Sequence
  Description of Artificial Sequence: Synthetic oligonucleotide
atcttactaattcctctccg

SEQ ID NO: 4371 - DNA, 21 bp, Artificial Sequence
  Description of Artificial Sequence: Synthetic oligonucleotide
attttcattttttttccgccg

SEQ ID NO: 4372 - DNA, 20 bp, Artificial Sequence
  Description of Artificial Sequence: Synthetic oligonucleotide
gttttccttcattctttccg

SEQ ID NO: 4373 - DNA, 20 bp, Artificial Sequence
  Description of Artificial Sequence: Synthetic oligonucleotide
acttttcttcgttttacccg

SEQ ID NO: 4374 - DNA, 20 bp, Artificial Sequence
  Description of Artificial Sequence: Synthetic oligonucleotide
attctcttattatcttgccg

SEQ ID NO: 4375 - DNA, 21 bp, Artificial Sequence
  Description of Artificial Sequence: Synthetic oligonucleotide
tcttgtttttttttttggccc

SEQ ID NO: 4376 - DNA, 20 bp, Artificial Sequence
  Description of Artificial Sequence: Synthetic oligonucleotide
aatcttctcatttcttaccg

SEQ ID NO: 4377 - DNA, 20 bp, Artificial Sequence
  Description of Artificial Sequence: Synthetic oligonucleotide
atttcttctttttgcccctg

SEQ ID NO: 4378 - DNA, 20 bp, Artificial Sequence
  Description of Artificial Sequence: Synthetic oligonucleotide
ttttatgtctttttgctccg

SEQ ID NO: 4379 - DNA, 20 bp, Artificial Sequence
  Description of Artificial Sequence: Synthetic oligonucleotide
gttttcttttcatttttccc

SEQ ID NO: 4380 - DNA, 21 bp, Artificial Sequence
  Description of Artificial Sequence: Synthetic oligonucleotide
tctttttttgtctttcttccg

SEQ ID NO: 4381 - DNA, 20 bp, Artificial Sequence
  Description of Artificial Sequence: Synthetic oligonucleotide
acttttttctctcttttctg

SEQ ID NO: 4382 - DNA, 20 bp, Artificial Sequence
  Description of Artificial Sequence: Synthetic oligonucleotide
ttttttaacttctttttccg

SEQ ID NO: 4383 - DNA, 19 bp, Artificial Sequence
  Description of Artificial Sequence: Synthetic oligonucleotide
acttttcttgtttattctg

SEQ ID NO: 4384 - DNA, 20 bp, Artificial Sequence
  Description of Artificial Sequence: Synthetic oligonucleotide
ttattttttatccttttccg

SEQ ID NO: 4385 - DNA, 22 bp, Artificial Sequence
  Description of Artificial Sequence: Synthetic oligonucleotide
ttctttattttttttccctccg

SEQ ID NO: 4386 - DNA, 19 bp, Artificial Sequence
  Description of Artificial Sequence: Synthetic oligonucleotide
tcctttcgttctgcctccc

SEQ ID NO: 4387 - DNA, 20 bp, Artificial Sequence
  Description of Artificial Sequence: Synthetic oligonucleotide
atctttctctttactctccg

SEQ ID NO: 4388 - DNA, 20 bp, Artificial Sequence
  Description of Artificial Sequence: Synthetic oligonucleotide
tttatttttcattcgccccg

SEQ ID NO: 4389 - DNA, 22 bp, Artificial Sequence
  Description of Artificial Sequence: Synthetic oligonucleotide
accgctcttttctttttctccg

SEQ ID NO: 4390 - DNA, 20 bp, Artificial Sequence
  Description of Artificial Sequence: Synthetic oligonucleotide
tcttttcatctactcatccg

SEQ ID NO: 4391 - DNA, 20 bp, Artificial Sequence
  Description of Artificial Sequence: Synthetic oligonucleotide
tttcactctctttcactccg

SEQ ID NO: 4392 - DNA, 20 bp, Artificial Sequence
  Description of Artificial Sequence: Synthetic oligonucleotide
tcttttgtaattgctctccg

SEQ ID NO: 4393 - DNA, 20 bp, Artificial Sequence
  Description of Artificial Sequence: Synthetic oligonucleotide
tttgttattcatttttgccc

SEQ ID NO: 4394 - DNA, 20 bp, Artificial Sequence
  Description of Artificial Sequence: Synthetic oligonucleotide
gttctctttttattctgccc

SEQ ID NO: 4395 - DNA, 20 bp, Artificial Sequence
  Description of Artificial Sequence: Synthetic oligonucleotide
tccgtttctttctttatccg

SEQ ID NO: 4396 - DNA, 20 bp, Artificial Sequence
  Description of Artificial Sequence: Synthetic oligonucleotide
ttttccaatgctcttttccg

SEQ ID NO: 4397 - DNA, 20 bp, Artificial Sequence
  Description of Artificial Sequence: Synthetic oligonucleotide
tttgggagtatggtgttccg

SEQ ID NO: 4398 - DNA, 20 bp, Artificial Sequence
  Description of Artificial Sequence: Synthetic oligonucleotide
tattcatcttattctctccg

SEQ ID NO: 4399 - DNA, 20 bp, Artificial Sequence
  Description of Artificial Sequence: Synthetic oligonucleotide
cttttaacattctctttccg

SEQ ID NO: 4400 - DNA, 20 bp, Artificial Sequence
  Description of Artificial Sequence: Synthetic oligonucleotide
gatctactttcttttcaccc

SEQ ID NO: 4401 - DNA, 20 bp, Artificial Sequence
  Description of Artificial Sequence: Synthetic oligonucleotide
gtcttttgattcttttgccg

SEQ ID NO: 4402 - DNA, 20 bp, Artificial Sequence
  Description of Artificial Sequence: Synthetic oligonucleotide
ttttttctttgccctttccg

SEQ ID NO: 4403 - DNA, 20 bp, Artificial Sequence
  Description of Artificial Sequence: Synthetic oligonucleotide
tgttttttatgcttttgccg

SEQ ID NO: 4404 - DNA, 20 bp, Artificial Sequence
  Description of Artificial Sequence: Synthetic oligonucleotide
cttttattttttctttgccc

SEQ ID NO: 4405 - DNA, 20 bp, Artificial Sequence
  Description of Artificial Sequence: Synthetic oligonucleotide
ctctctttacattttctccg

SEQ ID NO: 4406 - DNA, 20 bp, Artificial Sequence
  Description of Artificial Sequence: Synthetic oligonucleotide
atttcttagcttccttaccg

SEQ ID NO: 4407 - DNA, 20 bp, Artificial Sequence
  Description of Artificial Sequence: Synthetic oligonucleotide
cttttcacttttctcttctg

SEQ ID NO: 4408 - DNA, 20 bp, Artificial Sequence
  Description of Artificial Sequence: Synthetic oligonucleotide
tatctttaattctttttccg

SEQ ID NO: 4409 - DNA, 20 bp, Artificial Sequence
  Description of Artificial Sequence: Synthetic oligonucleotide
cttttccttattctttaccg

SEQ ID NO: 4410 - DNA, 21 bp, Artificial Sequence
  Description of Artificial Sequence: Synthetic oligonucleotide
atttttttagttctgtttccg

SEQ ID NO: 4411 - DNA, 20 bp, Artificial Sequence
  Description of Artificial Sequence: Synthetic oligonucleotide
tcttttctaattttaccccg

SEQ ID NO: 4412 - DNA, 20 bp, Artificial Sequence
  Description of Artificial Sequence: Synthetic oligonucleotide
ttttcacttacacttttcgc

SEQ ID NO: 4413 - DNA, 20 bp, Artificial Sequence
  Description of Artificial Sequence: Synthetic oligonucleotide
ttttacacttactttttcgc

SEQ ID NO: 4414 - DNA, 20 bp, Artificial Sequence
  Description of Artificial Sequence: Synthetic oligonucleotide
tttttatctcgttttttctg

SEQ ID NO: 4415 - DNA, 20 bp, Artificial Sequence
  Description of Artificial Sequence: Synthetic oligonucleotide
attatttctttcttttactg

SEQ ID NO: 4416 - DNA, 20 bp, Artificial Sequence
  Description of Artificial Sequence: Synthetic oligonucleotide
tttttctatgttcttttcgc

SEQ ID NO: 4417 - DNA, 21 bp, Artificial Sequence
  Description of Artificial Sequence: Synthetic oligonucleotide
ttttttgtttctctgttgctg

SEQ ID NO: 4418 - DNA, 20 bp, Artificial Sequence
  Description of Artificial Sequence: Synthetic oligonucleotide
ttttcgagtacctttttccg

SEQ ID NO: 4419 - DNA, 20 bp, Artificial Sequence
  Description of Artificial Sequence: Synthetic oligonucleotide
ttttcgttgtttttgtttcg

SEQ ID NO: 4420 - DNA, 21 bp, Artificial Sequence
  Description of Artificial Sequence: Synthetic oligonucleotide
tttctacttttttattgtccg

SEQ ID NO: 4421 - DNA, 20 bp, Artificial Sequence
  Description of Artificial Sequence: Synthetic oligonucleotide
ttagtgtttagttttttgtg

SEQ ID NO: 4422 - DNA, 20 bp, Artificial Sequence
  Description of Artificial Sequence: Synthetic oligonucleotide
tatttcacttactttttctg

SEQ ID NO: 4423 - DNA, 20 bp, Artificial Sequence
  Description of Artificial Sequence: Synthetic oligonucleotide
ttttcacttcttattccccg

SEQ ID NO: 4424 - DNA, 20 bp, Artificial Sequence
  Description of Artificial Sequence: Synthetic oligonucleotide
cgtttcctctggctcgtccc

SEQ ID NO: 4425 - DNA, 18 bp, Artificial Sequence
  Description of Artificial Sequence: Synthetic oligonucleotide
ttgtcgtctgttcgtccc

SEQ ID NO: 4426 - DNA, 20 bp, Artificial Sequence
  Description of Artificial Sequence: Synthetic oligonucleotide
atcttactctcttttcgccg

SEQ ID NO: 4427 - DNA, 20 bp, Artificial Sequence
  Description of Artificial Sequence: Synthetic oligonucleotide
ctttgctctttttgttaccg

SEQ ID NO: 4428 - DNA, 20 bp, Artificial Sequence
  Description of Artificial Sequence: Synthetic oligonucleotide
tttgggagtagggtgttctg

SEQ ID NO: 4429 - DNA, 20 bp, Artificial Sequence
  Description of Artificial Sequence: Synthetic oligonucleotide
gatttcttattccctttccc

SEQ ID NO: 4430 - DNA, 20 bp, Artificial Sequence
  Description of Artificial Sequence: Synthetic oligonucleotide
tatcttttctttttccccgg

SEQ ID NO: 4431 - DNA, 20 bp, Artificial Sequence
  Description of Artificial Sequence: Synthetic oligonucleotide
tttcaaacttttactttccg

SEQ ID NO: 4432 - DNA, 20 bp, Artificial Sequence
  Description of Artificial Sequence: Synthetic oligonucleotide
tcatttatattcttcctccg

SEQ ID NO: 4433 - DNA, 20 bp, Artificial Sequence
  Description of Artificial Sequence: Synthetic oligonucleotide
catttcttcttttcgttcgc

SEQ ID NO: 4434 - DNA, 20 bp, Artificial Sequence
  Description of Artificial Sequence: Synthetic oligonucleotide
aacttttttcttttatgccg

SEQ ID NO: 4435 - DNA, 21 bp, Artificial Sequence
  Description of Artificial Sequence: Synthetic oligonucleotide
gtttgctctttttttctgccg

SEQ ID NO: 4436 - DNA, 20 bp, Artificial Sequence
  Description of Artificial Sequence: Synthetic oligonucleotide
cttttccactattcgttccg

SEQ ID NO: 4437 - DNA, 20 bp, Artificial Sequence
  Description of Artificial Sequence: Synthetic oligonucleotide
ttttttcatattacgctccg

SEQ ID NO: 4438 - DNA, 21 bp, Artificial Sequence
  Description of Artificial Sequence: Synthetic oligonucleotide
ttattttttcttcgctgtccg

SEQ ID NO: 4439 - DNA, 20 bp, Artificial Sequence
  Description of Artificial Sequence: Synthetic oligonucleotide
attcttcatcttttgccccg

SEQ ID NO: 4440 - DNA, 20 bp, Artificial Sequence
  Description of Artificial Sequence: Synthetic oligonucleotide
cttcatttatttctccaccg

SEQ ID NO: 4441 - DNA, 20 bp, Artificial Sequence
  Description of Artificial Sequence: Synthetic oligonucleotide
gctttctttcttctttcctg

SEQ ID NO: 4442 - DNA, 20 bp, Artificial Sequence
  Description of Artificial Sequence: Synthetic oligonucleotide
attctctttttctctaaccg

SEQ ID NO: 4443 - DNA, 20 bp, Artificial Sequence
  Description of Artificial Sequence: Synthetic oligonucleotide
catttctttatttctttccg

SEQ ID NO: 4444 - DNA, 20 bp, Artificial Sequence
  Description of Artificial Sequence: Synthetic oligonucleotide
ctatttctaatctctctccg

SEQ ID NO: 4445 - DNA, 20 bp, Artificial Sequence
  Description of Artificial Sequence: Synthetic oligonucleotide
cctacttttttctttttccg

SEQ ID NO: 4446 - DNA, 20 bp, Artificial Sequence
  Description of Artificial Sequence: Synthetic oligonucleotide
attcttttgtttttttcccg

SEQ ID NO: 4447 - DNA, 19 bp, Artificial Sequence
  Description of Artificial Sequence: Synthetic oligonucleotide
cttttttatttcccttccg

SEQ ID NO: 4448 - DNA, 20 bp, Artificial Sequence
  Description of Artificial Sequence: Synthetic oligonucleotide
tttttacagatttttgcccg

SEQ ID NO: 4449 - DNA, 20 bp, Artificial Sequence
  Description of Artificial Sequence: Synthetic oligonucleotide
ttttattgattttgtttccc

SEQ ID NO: 4450 - DNA, 20 bp, Artificial Sequence
  Description of Artificial Sequence: Synthetic oligonucleotide
tatttctctattttcctctg

SEQ ID NO: 4451 - DNA, 20 bp, Artificial Sequence
  Description of Artificial Sequence: Synthetic oligonucleotide
tgttttctttcttcattccg

SEQ ID NO: 4452 - DNA, 20 bp, Artificial Sequence
  Description of Artificial Sequence: Synthetic oligonucleotide
tttatttctttgctcttgcc

SEQ ID NO: 4453 - DNA, 20 bp, Artificial Sequence
  Description of Artificial Sequence: Synthetic oligonucleotide
attttattccttttttcccg

SEQ ID NO: 4454 - DNA, 20 bp, Artificial Sequence
  Description of Artificial Sequence: Synthetic oligonucleotide
tttatttttttttcgctccg

SEQ ID NO: 4455 - DNA, 20 bp, Artificial Sequence
  Description of Artificial Sequence: Synthetic oligonucleotide
tctgaataggaggaggaggc

SEQ ID NO: 4456 - DNA, 20 bp, Artificial Sequence
  Description of Artificial Sequence: Synthetic oligonucleotide
tttcgctttcatattttccg

SEQ ID NO: 4457 - DNA, 20 bp, Artificial Sequence
  Description of Artificial Sequence: Synthetic oligonucleotide
actttttgttattttttgcc

SEQ ID NO: 4458 - DNA, 20 bp, Artificial Sequence
  Description of Artificial Sequence: Synthetic oligonucleotide
tcctggcttgtcgttgcccc

SEQ ID NO: 4459 - DNA, 20 bp, Artificial Sequence
  Description of Artificial Sequence: Synthetic oligonucleotide
tctattcttttgctcttccg

SEQ ID NO: 4460 - DNA, 20 bp, Artificial Sequence
  Description of Artificial Sequence: Synthetic oligonucleotide
attctttgtatttttgcccg

SEQ ID NO: 4461 - DNA, 20 bp, Artificial Sequence
  Description of Artificial Sequence: Synthetic oligonucleotide
attttattcccttgttgccg

SEQ ID NO: 4462 - DNA, 20 bp, Artificial Sequence
  Description of Artificial Sequence: Synthetic oligonucleotide
atcgctctattttttctccg

SEQ ID NO: 4463 - DNA, 20 bp, Artificial Sequence
  Description of Artificial Sequence: Synthetic oligonucleotide
ctccttgttcttttcctccg

SEQ ID NO: 4464 - DNA, 20 bp, Artificial Sequence
  Description of Artificial Sequence: Synthetic oligonucleotide
ggcttttaccttttttcccc

SEQ ID NO: 4465 - DNA, 20 bp, Artificial Sequence
  Description of Artificial Sequence: Synthetic oligonucleotide
tatttctcttaactcctccg

SEQ ID NO: 4466 - DNA, 22 bp, Artificial Sequence
  Description of Artificial Sequence: Synthetic oligonucleotide
tcttgttttttttttttggccc

SEQ ID NO: 4467 - DNA, 20 bp, Artificial Sequence
  Description of Artificial Sequence: Synthetic oligonucleotide
cttttctctttcacctaccg

SEQ ID NO: 4468 - DNA, 20 bp, Artificial Sequence
  Description of Artificial Sequence: Synthetic oligonucleotide
ttttctatcttctttgtccg

SEQ ID NO: 4469 - DNA, 20 bp, Artificial Sequence
  Description of Artificial Sequence: Synthetic oligonucleotide
ctttctcacccttttttccg

SEQ ID NO: 4470 - DNA, 20 bp, Artificial Sequence
  Description of Artificial Sequence: Synthetic oligonucleotide
ttttattaaatccgtttccg

SEQ ID NO: 4471 - DNA, 20 bp, Artificial Sequence
  Description of Artificial Sequence: Synthetic oligonucleotide
atcttctttgttttttgctg

SEQ ID NO: 4472 - DNA, 20 bp, Artificial Sequence
  Description of Artificial Sequence: Synthetic oligonucleotide
aaaaaggaggaggtggtgtg

SEQ ID NO: 4473 - DNA, 19 bp, Artificial Sequence
  Description of Artificial Sequence: Synthetic oligonucleotide
tctttttttgtttcccccg

SEQ ID NO: 4474 - DNA, 20 bp, Artificial Sequence
  Description of Artificial Sequence: Synthetic oligonucleotide
cctttttccttatctttccg

SEQ ID NO: 4475 - DNA, 20 bp, Artificial Sequence
  Description of Artificial Sequence: Synthetic oligonucleotide
attctctttttctattaccg

SEQ ID NO: 4476 - DNA, 21 bp, Artificial Sequence
  Description of Artificial Sequence: Synthetic oligonucleotide
gttcatgttttccttttcgtc

SEQ ID NO: 4477 - DNA, 20 bp, Artificial Sequence
  Description of Artificial Sequence: Synthetic oligonucleotide
attttgtctttttccttctg

SEQ ID NO: 4478 - DNA, 20 bp, Artificial Sequence
  Description of Artificial Sequence: Synthetic oligonucleotide
tttctgtttttttattcccg

SEQ ID NO: 4479 - DNA, 20 bp, Artificial Sequence
  Description of Artificial Sequence: Synthetic oligonucleotide
tctttcttttcttatttccg

SEQ ID NO: 4480 - DNA, 20 bp, Artificial Sequence
  Description of Artificial Sequence: Synthetic oligonucleotide
attggtgaagggtggttgcg

SEQ ID NO: 4481 - DNA, 20 bp, Artificial Sequence
  Description of Artificial Sequence: Synthetic oligonucleotide
gttttctctcttattttccg

SEQ ID NO: 4482 - DNA, 20 bp, Artificial Sequence
  Description of Artificial Sequence: Synthetic oligonucleotide
tacttatttgcctttttccg

SEQ ID NO: 4483 - DNA, 20 bp, Artificial Sequence
  Description of Artificial Sequence: Synthetic oligonucleotide
cctttttcattattcttccg

SEQ ID NO: 4484 - DNA, 20 bp, Artificial Sequence
  Description of Artificial Sequence: Synthetic oligonucleotide
catttattattttttccccg

SEQ ID NO: 4485 - DNA, 20 bp, Artificial Sequence
  Description of Artificial Sequence: Synthetic oligonucleotide
aatttttccttctttacccg

SEQ ID NO: 4486 - DNA, 20 bp, Artificial Sequence
  Description of Artificial Sequence: Synthetic oligonucleotide
ttttctttttctattttgcc

SEQ ID NO: 4487 - DNA, 20 bp, Artificial Sequence
  Description of Artificial Sequence: Synthetic oligonucleotide
tacttttctttcattttgcc

SEQ ID NO: 4488 - DNA, 20 bp, Artificial Sequence
  Description of Artificial Sequence: Synthetic oligonucleotide
tttcacttttttactttcgc

SEQ ID NO: 4489 - DNA, 21 bp, Artificial Sequence
  Description of Artificial Sequence: Synthetic oligonucleotide
tatttcactgtttttttgctg

SEQ ID NO: 4490 - DNA, 20 bp, Artificial Sequence
  Description of Artificial Sequence: Synthetic oligonucleotide
tgttttttttacttttcccg

SEQ ID NO: 4491 - DNA, 20 bp, Artificial Sequence
  Description of Artificial Sequence: Synthetic oligonucleotide
tctggtttcttttgtttccg

SEQ ID NO: 4492 - DNA, 20 bp, Artificial Sequence
  Description of Artificial Sequence: Synthetic oligonucleotide
tatctcacactttctttccg

SEQ ID NO: 4493 - DNA, 20 bp, Artificial Sequence
  Description of Artificial Sequence: Synthetic oligonucleotide
attctcaatttctctcgccg

SEQ ID NO: 4494 - DNA, 21 bp, Artificial Sequence
  Description of Artificial Sequence: Synthetic oligonucleotide
ttatttttcctttttctgccg

SEQ ID NO: 4495 - DNA, 20 bp, Artificial Sequence
  Description of Artificial Sequence: Synthetic oligonucleotide
tttctcttaattttcccccg

SEQ ID NO: 4496 - DNA, 20 bp, Artificial Sequence
  Description of Artificial Sequence: Synthetic oligonucleotide
tcatctttactcttcatccg

SEQ ID NO: 4497 - DNA, 19 bp, Artificial Sequence
  Description of Artificial Sequence: Synthetic oligonucleotide
ttttgctttttttttcccc

SEQ ID NO: 4498 - DNA, 20 bp, Artificial Sequence
  Description of Artificial Sequence: Synthetic oligonucleotide
tttttcattccccttttccg

SEQ ID NO: 4499 - DNA, 21 bp, Artificial Sequence
  Description of Artificial Sequence: Synthetic oligonucleotide
cttttcctttttttcactccg

SEQ ID NO: 4500 - DNA, 20 bp, Artificial Sequence
  Description of Artificial Sequence: Synthetic oligonucleotide
tcttgttttttttttggccc

SEQ ID NO: 4501 - DNA, 19 bp, Artificial Sequence
  Description of Artificial Sequence: Synthetic oligonucleotide
tcactttttttcatctccg

SEQ ID NO: 4502 - DNA, 22 bp, Artificial Sequence
  Description of Artificial Sequence: Synthetic oligonucleotide
tttttttattttcctggttccg

SEQ ID NO: 4503 - DNA, 19 bp, Artificial Sequence
  Description of Artificial Sequence: Synthetic oligonucleotide
ttttcttgccctttttccg

SEQ ID NO: 4504 - DNA, 20 bp, Artificial Sequence
  Description of Artificial Sequence: Synthetic oligonucleotide
tttatgagagtagggtggtg

SEQ ID NO: 4505 - DNA, 20 bp, Artificial Sequence
  Description of Artificial Sequence: Synthetic oligonucleotide
attgttttattttctcaccc

SEQ ID NO: 4506 - DNA, 20 bp, Artificial Sequence
  Description of Artificial Sequence: Synthetic oligonucleotide
cttttacattattttctccg

SEQ ID NO: 4507 - DNA, 21 bp, Artificial Sequence
  Description of Artificial Sequence: Synthetic oligonucleotide
ttgtttctacctttttttccg

SEQ ID NO: 4508 - DNA, 18 bp, Artificial Sequence
  Description of Artificial Sequence: Synthetic oligonucleotide
tttatctttttttgtgtg

SEQ ID NO: 4509 - DNA, 20 bp, Artificial Sequence
  Description of Artificial Sequence: Synthetic oligonucleotide
atctttcgctttttttcccg

SEQ ID NO: 4510 - DNA, 20 bp, Artificial Sequence
  Description of Artificial Sequence: Synthetic oligonucleotide
ctttcctaattttctctccg

SEQ ID NO: 4511 - DNA, 20 bp, Artificial Sequence
  Description of Artificial Sequence: Synthetic oligonucleotide
ctgttcttttccttttaccc

SEQ ID NO: 4512 - DNA, 19 bp, Artificial Sequence
  Description of Artificial Sequence: Synthetic oligonucleotide
tttattctgtttttttccg

SEQ ID NO: 4513 - DNA, 20 bp, Artificial Sequence
  Description of Artificial Sequence: Synthetic oligonucleotide
ttttactgtttttctttgcg

SEQ ID NO: 4514 - DNA, 20 bp, Artificial Sequence
  Description of Artificial Sequence: Synthetic oligonucleotide
cttttgtttgtttctttgcg

SEQ ID NO: 4515 - DNA, 20 bp, Artificial Sequence
  Description of Artificial Sequence: Synthetic oligonucleotide
ttctatttaatttttctccg

SEQ ID NO: 4516 - DNA, 20 bp, Artificial Sequence
  Description of Artificial Sequence: Synthetic oligonucleotide
gttttcaagacttttttccc

SEQ ID NO: 4517 - DNA, 20 bp, Artificial Sequence
  Description of Artificial Sequence: Synthetic oligonucleotide
tttgtaatgttttttttccg

SEQ ID NO: 4518 - DNA, 21 bp, Artificial Sequence
  Description of Artificial Sequence: Synthetic oligonucleotide
ttcgtactttttttttttccg

SEQ ID NO: 4519 - DNA, 21 bp, Artificial Sequence
  Description of Artificial Sequence: Synthetic oligonucleotide
cttttttttcctttttttccg

SEQ ID NO: 4520 - DNA, 20 bp, Artificial Sequence
  Description of Artificial Sequence: Synthetic oligonucleotide
atcttcattatctttttgcc

SEQ ID NO: 4521 - DNA, 20 bp, Artificial Sequence
  Description of Artificial Sequence: Synthetic oligonucleotide
tttttgcacttatttttccg

SEQ ID NO: 4522 - DNA, 22 bp, Artificial Sequence
  Description of Artificial Sequence: Synthetic oligonucleotide
tattttgtcacttttttttctg

SEQ ID NO: 4523 - DNA, 20 bp, Artificial Sequence
  Description of Artificial Sequence: Synthetic oligonucleotide
tgttttttcttttctgtctg

SEQ ID NO: 4524 - DNA, 20 bp, Artificial Sequence
  Description of Artificial Sequence: Synthetic oligonucleotide
tttcgattttattttttccc

SEQ ID NO: 4525 - DNA, 20 bp, Artificial Sequence
  Description of Artificial Sequence: Synthetic oligonucleotide
attacctttttccctttccg

SEQ ID NO: 4526 - DNA, 20 bp, Artificial Sequence
  Description of Artificial Sequence: Synthetic oligonucleotide
agttttttccatttttgccc

SEQ ID NO: 4527 - DNA, 20 bp, Artificial Sequence
  Description of Artificial Sequence: Synthetic oligonucleotide
actacttttctctttttccg

SEQ ID NO: 4528 - DNA, 20 bp, Artificial Sequence
  Description of Artificial Sequence: Synthetic oligonucleotide
catttactttttaccctccg

SEQ ID NO: 4529 - DNA, 20 bp, Artificial Sequence
  Description of Artificial Sequence: Synthetic oligonucleotide
tttccttttccttttcccgc

SEQ ID NO: 4530 - DNA, 20 bp, Artificial Sequence
  Description of Artificial Sequence: Synthetic oligonucleotide
gattttcttcctttttgccg

SEQ ID NO: 4531 - DNA, 20 bp, Artificial Sequence
  Description of Artificial Sequence: Synthetic oligonucleotide
tttcctaaatttttcctccg

SEQ ID NO: 4532 - DNA, 20 bp, Artificial Sequence
  Description of Artificial Sequence: Synthetic oligonucleotide
tctcatctatttttcttccg

SEQ ID NO: 4533 - DNA, 20 bp, Artificial Sequence
  Description of Artificial Sequence: Synthetic oligonucleotide
acttctctattcttttcccg

SEQ ID NO: 4534 - DNA, 21 bp, Artificial Sequence
  Description of Artificial Sequence: Synthetic oligonucleotide
tttttttgattcttgtttccg

SEQ ID NO: 4535 - DNA, 20 bp, Artificial Sequence
  Description of Artificial Sequence: Synthetic oligonucleotide
ttctttgtctattttcccgc

SEQ ID NO: 4536 - DNA, 20 bp, Artificial Sequence
  Description of Artificial Sequence: Synthetic oligonucleotide
tcattttaatttgctctccg

SEQ ID NO: 4537 - DNA, 20 bp, Artificial Sequence
  Description of Artificial Sequence: Synthetic oligonucleotide
cttttaatctctttttaccg

SEQ ID NO: 4538 - DNA, 20 bp, Artificial Sequence
  Description of Artificial Sequence: Synthetic oligonucleotide
ttatttgtgatttttttccg

SEQ ID NO: 4539 - DNA, 20 bp, Artificial Sequence
  Description of Artificial Sequence: Synthetic oligonucleotide
tttctcagcttttttttccg

SEQ ID NO: 4540 - DNA, 20 bp, Artificial Sequence
  Description of Artificial Sequence: Synthetic oligonucleotide
gactttattcttttcttgcc

SEQ ID NO: 4541 - DNA, 20 bp, Artificial Sequence
  Description of Artificial Sequence: Synthetic oligonucleotide
ttttacattttttttcgctg

SEQ ID NO: 4542 - DNA, 21 bp, Artificial Sequence
  Description of Artificial Sequence: Synthetic oligonucleotide
atttttttcctgtttttgccg

SEQ ID NO: 4543 - DNA, 21 bp, Artificial Sequence
  Description of Artificial Sequence: Synthetic oligonucleotide
tttctttcatttttttttccg

SEQ ID NO: 4544 - DNA, 20 bp, Artificial Sequence
  Description of Artificial Sequence: Synthetic oligonucleotide
actttttgcttatttacccg

SEQ ID NO: 4545 - DNA, 20 bp, Artificial Sequence
  Description of Artificial Sequence: Synthetic oligonucleotide
ttttgcttttttttttcccc

SEQ ID NO: 4546 - DNA, 20 bp, Artificial Sequence
  Description of Artificial Sequence: Synthetic oligonucleotide
actttttctcttttctaccg

SEQ ID NO: 4547 - DNA, 20 bp, Artificial Sequence
  Description of Artificial Sequence: Synthetic oligonucleotide
ttcgcttaattcttttcccg

SEQ ID NO: 4548 - DNA, 20 bp, Artificial Sequence
  Description of Artificial Sequence: Synthetic oligonucleotide
ttttatttatttctgtcccg

SEQ ID NO: 4549 - DNA, 20 bp, Artificial Sequence
  Description of Artificial Sequence: Synthetic oligonucleotide
ttttcttcaatattttcccg

SEQ ID NO: 4550 - DNA, 20 bp, Artificial Sequence
  Description of Artificial Sequence: Synthetic oligonucleotide
tcttattatttctttcccgc

SEQ ID NO: 4551 - DNA, 20 bp, Artificial Sequence
  Description of Artificial Sequence: Synthetic oligonucleotide
tgtttttctatttttttccc

SEQ ID NO: 4552 - DNA, 20 bp, Artificial Sequence
  Description of Artificial Sequence: Synthetic oligonucleotide
attttatttctcttttcccg

SEQ ID NO: 4553 - DNA, 20 bp, Artificial Sequence
  Description of Artificial Sequence: Synthetic oligonucleotide
attcttttttgttttttgcc

SEQ ID NO: 4554 - DNA, 20 bp, Artificial Sequence
  Description of Artificial Sequence: Synthetic oligonucleotide
tccttgtcgtctcgcgtccc

SEQ ID NO: 4555 - DNA, 20 bp, Artificial Sequence
  Description of Artificial Sequence: Synthetic oligonucleotide
tttgggagtaaggtgttccg

SEQ ID NO: 4556 - DNA, 20 bp, Artificial Sequence
  Description of Artificial Sequence: Synthetic oligonucleotide
gttcttatccttctgttccg

SEQ ID NO: 4557 - DNA, 20 bp, Artificial Sequence
  Description of Artificial Sequence: Synthetic oligonucleotide
tttttcgatctttgtttccg

SEQ ID NO: 4558 - DNA, 20 bp, Artificial Sequence
  Description of Artificial Sequence: Synthetic oligonucleotide
atttcttcacttgctcaccg

SEQ ID NO: 4559 - DNA, 20 bp, Artificial Sequence
  Description of Artificial Sequence: Synthetic oligonucleotide
aactctctctttttctgccg

SEQ ID NO: 4560 - DNA, 20 bp, Artificial Sequence
  Description of Artificial Sequence: Synthetic oligonucleotide
gttgttcttttacctccggc

SEQ ID NO: 4561 - DNA, 19 bp, Artificial Sequence
  Description of Artificial Sequence: Synthetic oligonucleotide
ttccacttttttttctccg

SEQ ID NO: 4562 - DNA, 20 bp, Artificial Sequence
  Description of Artificial Sequence: Synthetic oligonucleotide
tctattctctatttcttccg

SEQ ID NO: 4563 - DNA, 20 bp, Artificial Sequence
  Description of Artificial Sequence: Synthetic oligonucleotide
catttcacttcttttcgctg

SEQ ID NO: 4564 - DNA, 20 bp, Artificial Sequence
  Description of Artificial Sequence: Synthetic oligonucleotide
acatttcattttttcccccg

SEQ ID NO: 4565 - DNA, 20 bp, Artificial Sequence
  Description of Artificial Sequence: Synthetic oligonucleotide
cttctattattttccatccg

SEQ ID NO: 4566 - DNA, 20 bp, Artificial Sequence
  Description of Artificial Sequence: Synthetic oligonucleotide
tatttcactgttttttgctg

SEQ ID NO: 4567 - DNA, 20 bp, Artificial Sequence
  Description of Artificial Sequence: Synthetic oligonucleotide
actttctctctctctttccg

SEQ ID NO: 4568 - DNA, 20 bp, Artificial Sequence
  Description of Artificial Sequence: Synthetic oligonucleotide
tctttacttttacatctccg

SEQ ID NO: 4569 - DNA, 20 bp, Artificial Sequence
  Description of Artificial Sequence: Synthetic oligonucleotide
attttattctttggttcccg

SEQ ID NO: 4570 - DNA, 20 bp, Artificial Sequence
  Description of Artificial Sequence: Synthetic oligonucleotide
actcattcatttctctaccg

SEQ ID NO: 4571 - DNA, 20 bp, Artificial Sequence
  Description of Artificial Sequence: Synthetic oligonucleotide
cttttaaatttctccttccg

SEQ ID NO: 4572 - DNA, 20 bp, Artificial Sequence
  Description of Artificial Sequence: Synthetic oligonucleotide
ccattttttcttttcctgcc

SEQ ID NO: 4573 - DNA, 20 bp, Artificial Sequence
  Description of Artificial Sequence: Synthetic oligonucleotide
atttcttcgactttcctccg

SEQ ID NO: 4574 - DNA, 20 bp, Artificial Sequence
  Description of Artificial Sequence: Synthetic oligonucleotide
tttctacacttctttttccg

SEQ ID NO: 4575 - DNA, 20 bp, Artificial Sequence
  Description of Artificial Sequence: Synthetic oligonucleotide
attttgttatgtttttgcca

SEQ ID NO: 4576 - DNA, 22 bp, Artificial Sequence
  Description of Artificial Sequence: Synthetic oligonucleotide
tcttttttttgtttttctgccg

SEQ ID NO: 4577 - DNA, 20 bp, Artificial Sequence
  Description of Artificial Sequence: Synthetic oligonucleotide
cctttctttccatttttccg

SEQ ID NO: 4578 - DNA, 20 bp, Artificial Sequence
  Description of Artificial Sequence: Synthetic oligonucleotide
atctttacattcacttaccg

SEQ ID NO: 4579 - DNA, 20 bp, Artificial Sequence
  Description of Artificial Sequence: Synthetic oligonucleotide
tttcatactcattttttccg

SEQ ID NO: 4580 - DNA, 20 bp, Artificial Sequence
  Description of Artificial Sequence: Synthetic oligonucleotide
ccttttctacttcttatccg

SEQ ID NO: 4581 - DNA, 20 bp, Artificial Sequence
  Description of Artificial Sequence: Synthetic oligonucleotide
actttttatttttatcaccg

SEQ ID NO: 4582 - DNA, 20 bp, Artificial Sequence
  Description of Artificial Sequence: Synthetic oligonucleotide
gcttctctcgttttttcccg

SEQ ID NO: 4583 - DNA, 20 bp, Artificial Sequence
  Description of Artificial Sequence: Synthetic oligonucleotide
acgttttcttctatttaccg

SEQ ID NO: 4584 - DNA, 20 bp, Artificial Sequence
  Description of Artificial Sequence: Synthetic oligonucleotide
tttcatctcactttttcccg

SEQ ID NO: 4585 - DNA, 20 bp, Artificial Sequence
  Description of Artificial Sequence: Synthetic oligonucleotide
gttgtttggtttcttttccg

SEQ ID NO: 4586 - DNA, 20 bp, Artificial Sequence
  Description of Artificial Sequence: Synthetic oligonucleotide
tttttcatttcatctctccg

SEQ ID NO: 4587 - DNA, 20 bp, Artificial Sequence
  Description of Artificial Sequence: Synthetic oligonucleotide
tcattttctgttttcttctg

SEQ ID NO: 4588 - DNA, 20 bp, Artificial Sequence
  Description of Artificial Sequence: Synthetic oligonucleotide
ttcttgtgtttttctttctg

SEQ ID NO: 4589 - DNA, 20 bp, Artificial Sequence
  Description of Artificial Sequence: Synthetic oligonucleotide
ttttgtttttcttttgttcc

SEQ ID NO: 4590 - DNA, 20 bp, Artificial Sequence
  Description of Artificial Sequence: Synthetic oligonucleotide
ttcttgttatttttcccctg

SEQ ID NO: 4591 - DNA, 20 bp, Artificial Sequence
  Description of Artificial Sequence: Synthetic oligonucleotide
gcttttcttccttttttccg

SEQ ID NO: 4592 - DNA, 21 bp, Artificial Sequence
  Description of Artificial Sequence: Synthetic oligonucleotide
ccttgtttgttttttttcccg

SEQ ID NO: 4593 - DNA, 20 bp, Artificial Sequence
  Description of Artificial Sequence: Synthetic oligonucleotide
gtttcttatctttttttccg

SEQ ID NO: 4594 - DNA, 20 bp, Artificial Sequence
  Description of Artificial Sequence: Synthetic oligonucleotide
attattttctctatttactg

SEQ ID NO: 4595 - DNA, 18 bp, Artificial Sequence
  Description of Artificial Sequence: Synthetic oligonucleotide
tcctgtcgtctgtgtccc

SEQ ID NO: 4596 - DNA, 19 bp, Artificial Sequence
  Description of Artificial Sequence: Synthetic oligonucleotide
tcctgtcgtctctcgtccc

SEQ ID NO: 4597 - DNA, 20 bp, Artificial Sequence
  Description of Artificial Sequence: Synthetic oligonucleotide
tcctttcgttctaccctccc

SEQ ID NO: 4598 - DNA, 18 bp, Artificial Sequence
  Description of Artificial Sequence: Synthetic oligonucleotide
tttgggagtagggttccg

SEQ ID NO: 4599 - DNA, 20 bp, Artificial Sequence
  Description of Artificial Sequence: Synthetic oligonucleotide
gttggtgtaggggggttccc

SEQ ID NO: 4600 - DNA, 20 bp, Artificial Sequence
  Description of Artificial Sequence: Synthetic oligonucleotide
ttttcgtgttttctattgtg

SEQ ID NO: 4601 - DNA, 21 bp, Artificial Sequence
  Description of Artificial Sequence: Synthetic oligonucleotide
gcctttcgttcttgccctccc

SEQ ID NO: 4602 - DNA, 20 bp, Artificial Sequence
  Description of Artificial Sequence: Synthetic oligonucleotide
taattcttctttttgctccc

SEQ ID NO: 4603 - DNA, 20 bp, Artificial Sequence
  Description of Artificial Sequence: Synthetic oligonucleotide
tcgttgtttcttttttcccc

SEQ ID NO: 4604 - DNA, 20 bp, Artificial Sequence
  Description of Artificial Sequence: Synthetic oligonucleotide
ttgttttttccttttctcgc

SEQ ID NO: 4605 - DNA, 20 bp, Artificial Sequence
  Description of Artificial Sequence: Synthetic oligonucleotide
tcatttctcttcctattccg

SEQ ID NO: 4606 - DNA, 21 bp, Artificial Sequence
  Description of Artificial Sequence: Synthetic oligonucleotide
cttttttcttctcttgttccg

SEQ ID NO: 4607 - DNA, 20 bp, Artificial Sequence
  Description of Artificial Sequence: Synthetic oligonucleotide
tttcacttttttttccccgc

SEQ ID NO: 4608 - DNA, 20 bp, Artificial Sequence
  Description of Artificial Sequence: Synthetic oligonucleotide
attttttcccattttttccg

SEQ ID NO: 4609 - DNA, 20 bp, Artificial Sequence
  Description of Artificial Sequence: Synthetic oligonucleotide
cttaatttgcttcctttccg

SEQ ID NO: 4610 - DNA, 20 bp, Artificial Sequence
  Description of Artificial Sequence: Synthetic oligonucleotide
ggtttgtttttctgttgccg

SEQ ID NO: 4611 - DNA, 20 bp, Artificial Sequence
  Description of Artificial Sequence: Synthetic oligonucleotide
gttcttgtaccttttttccg

SEQ ID NO: 4612 - DNA, 21 bp, Artificial Sequence
  Description of Artificial Sequence: Synthetic oligonucleotide
tctttttcatttttcgttccg

SEQ ID NO: 4613 - DNA, 20 bp, Artificial Sequence
  Description of Artificial Sequence: Synthetic oligonucleotide
ttatttcatcttcttttgtg

SEQ ID NO: 4614 - DNA, 22 bp, Artificial Sequence
  Description of Artificial Sequence: Synthetic oligonucleotide
gtttacgtacctttttttaccg

SEQ ID NO: 4615 - DNA, 20 bp, Artificial Sequence
  Description of Artificial Sequence: Synthetic oligonucleotide
ctcttttgttcttatttccg

SEQ ID NO: 4616 - DNA, 20 bp, Artificial Sequence
  Description of Artificial Sequence: Synthetic oligonucleotide
tttttaatgatttgttcccg

SEQ ID NO: 4617 - DNA, 20 bp, Artificial Sequence
  Description of Artificial Sequence: Synthetic oligonucleotide
ttttttagatttttgctccc

SEQ ID NO: 4618 - DNA, 20 bp, Artificial Sequence
  Description of Artificial Sequence: Synthetic oligonucleotide
tttctctttatatcgttccg

SEQ ID NO: 4619 - DNA, 20 bp, Artificial Sequence
  Description of Artificial Sequence: Synthetic oligonucleotide
atttttttctttttttgccg

SEQ ID NO: 4620 - DNA, 20 bp, Artificial Sequence
  Description of Artificial Sequence: Synthetic oligonucleotide
gttctatacttttccttccg

SEQ ID NO: 4621 - DNA, 20 bp, Artificial Sequence
  Description of Artificial Sequence: Synthetic oligonucleotide
gtttgctcaacttttttccg

SEQ ID NO: 4622 - DNA, 20 bp, Artificial Sequence
  Description of Artificial Sequence: Synthetic oligonucleotide
ccattttaaatttctctccg

SEQ ID NO: 4623 - DNA, 20 bp, Artificial Sequence
  Description of Artificial Sequence: Synthetic oligonucleotide
ttttattctttttctccctg

SEQ ID NO: 4624 - DNA, 20 bp, Artificial Sequence
  Description of Artificial Sequence: Synthetic oligonucleotide
attcttcatcatttcttccg

SEQ ID NO: 4625 - DNA, 20 bp, Artificial Sequence
  Description of Artificial Sequence: Synthetic oligonucleotide
aatattactttttttccccg

SEQ ID NO: 4626 - DNA, 20 bp, Artificial Sequence
  Description of Artificial Sequence: Synthetic oligonucleotide
acttgttcgtttttttgctg

SEQ ID NO: 4627 - DNA, 20 bp, Artificial Sequence
  Description of Artificial Sequence: Synthetic oligonucleotide
tttttctaatttcgcttgtg

SEQ ID NO: 4628 - DNA, 20 bp, Artificial Sequence
  Description of Artificial Sequence: Synthetic oligonucleotide
tttttctcttgtttattgtg

SEQ ID NO: 4629 - DNA, 20 bp, Artificial Sequence
  Description of Artificial Sequence: Synthetic oligonucleotide
gctttttcgttctttttccg

SEQ ID NO: 4630 - DNA, 20 bp, Artificial Sequence
  Description of Artificial Sequence: Synthetic oligonucleotide
ccatctttttcttttttccg

SEQ ID NO: 4631 - DNA, 20 bp, Artificial Sequence
  Description of Artificial Sequence: Synthetic oligonucleotide
tttttattattcctgttgtg

SEQ ID NO: 4632 - DNA, 20 bp, Artificial Sequence
  Description of Artificial Sequence: Synthetic oligonucleotide
ttttctaattacttttcccc

SEQ ID NO: 4633 - DNA, 20 bp, Artificial Sequence
  Description of Artificial Sequence: Synthetic oligonucleotide
tttttatctttcttcttccg

SEQ ID NO: 4634 - DNA, 21 bp, Artificial Sequence
  Description of Artificial Sequence: Synthetic oligonucleotide
tcctgtcgttctgttcgtccc

SEQ ID NO: 4635 - DNA, 20 bp, Artificial Sequence
  Description of Artificial Sequence: Synthetic oligonucleotide
ttttttcccctttctttccg

SEQ ID NO: 4636 - DNA, 20 bp, Artificial Sequence
  Description of Artificial Sequence: Synthetic oligonucleotide
catttgttcttattcctccg

SEQ ID NO: 4637 - DNA, 20 bp, Artificial Sequence
  Description of Artificial Sequence: Synthetic oligonucleotide
tctcattcacgctttctccg

SEQ ID NO: 4638 - DNA, 20 bp, Artificial Sequence
  Description of Artificial Sequence: Synthetic oligonucleotide
ttcgggagtagggtgttccg

SEQ ID NO: 4639 - DNA, 20 bp, Artificial Sequence
  Description of Artificial Sequence: Synthetic oligonucleotide
gatttcgctcattttttgcc

SEQ ID NO: 4640 - DNA, 20 bp, Artificial Sequence
  Description of Artificial Sequence: Synthetic oligonucleotide
gttacttccttcttttcccg

SEQ ID NO: 4641 - DNA, 20 bp, Artificial Sequence
  Description of Artificial Sequence: Synthetic oligonucleotide
tttactctctcttttctccg

SEQ ID NO: 4642 - DNA, 20 bp, Artificial Sequence
  Description of Artificial Sequence: Synthetic oligonucleotide
acctattctctttttcaccg

SEQ ID NO: 4643 - DNA, 20 bp, Artificial Sequence
  Description of Artificial Sequence: Synthetic oligonucleotide
tcgtgtttattttttttccg

SEQ ID NO: 4644 - DNA, 20 bp, Artificial Sequence
  Description of Artificial Sequence: Synthetic oligonucleotide
tttctgttctttcttcaccg

SEQ ID NO: 4645 - DNA, 22 bp, Artificial Sequence
  Description of Artificial Sequence: Synthetic oligonucleotide
tcactttcgcatttttctaccg

SEQ ID NO: 4646 - DNA, 20 bp, Artificial Sequence
  Description of Artificial Sequence: Synthetic oligonucleotide
ctatcttttacttccctccg

SEQ ID NO: 4647 - DNA, 20 bp, Artificial Sequence
  Description of Artificial Sequence: Synthetic oligonucleotide
aatcctttttcttgtcaccg

SEQ ID NO: 4648 - DNA, 20 bp, Artificial Sequence
  Description of Artificial Sequence: Synthetic oligonucleotide
ttttttgtattgcttctccg

SEQ ID NO: 4649 - DNA, 21 bp, Artificial Sequence
  Description of Artificial Sequence: Synthetic oligonucleotide
acattctcttttttttcaccg

SEQ ID NO: 4650 - DNA, 20 bp, Artificial Sequence
  Description of Artificial Sequence: Synthetic oligonucleotide
cttttcgtctcttttatccg

SEQ ID NO: 4651 - DNA, 20 bp, Artificial Sequence
  Description of Artificial Sequence: Synthetic oligonucleotide
tttttcttttatttccgcgc

SEQ ID NO: 4652 - DNA, 20 bp, Artificial Sequence
  Description of Artificial Sequence: Synthetic oligonucleotide
tttcattcacgttttttccg

SEQ ID NO: 4653 - DNA, 20 bp, Artificial Sequence
  Description of Artificial Sequence: Synthetic oligonucleotide
aactttttctctttttaccc

SEQ ID NO: 4654 - DNA, 20 bp, Artificial Sequence
  Description of Artificial Sequence: Synthetic oligonucleotide
ttttcatcaatttttctccg

SEQ ID NO: 4655 - DNA, 20 bp, Artificial Sequence
  Description of Artificial Sequence: Synthetic oligonucleotide
ttattcttttcttattcccc

SEQ ID NO: 4656 - DNA, 20 bp, Artificial Sequence
  Description of Artificial Sequence: Synthetic oligonucleotide
tttttattcttttacccccc

SEQ ID NO: 4657 - DNA, 19 bp, Artificial Sequence
  Description of Artificial Sequence: Synthetic oligonucleotide
cattttctacttttttccg

SEQ ID NO: 4658 - DNA, 20 bp, Artificial Sequence
  Description of Artificial Sequence: Synthetic oligonucleotide
tctttcgcactatttttccg

SEQ ID NO: 4659 - DNA, 20 bp, Artificial Sequence
  Description of Artificial Sequence: Synthetic oligonucleotide
gtttatttattgtttttccg

SEQ ID NO: 4660 - DNA, 22 bp, Artificial Sequence
  Description of Artificial Sequence: Synthetic oligonucleotide
atttcacgttgtttttttaccg

SEQ ID NO: 4661 - DNA, 19 bp, Artificial Sequence
  Description of Artificial Sequence: Synthetic oligonucleotide
tatttgttcttttgttgcg

SEQ ID NO: 4662 - DNA, 20 bp, Artificial Sequence
  Description of Artificial Sequence: Synthetic oligonucleotide
tatttttttccttttctccg

SEQ ID NO: 4663 - DNA, 20 bp, Artificial Sequence
  Description of Artificial Sequence: Synthetic oligonucleotide
ttctttatttttaccttcgc

SEQ ID NO: 4664 - DNA, 20 bp, Artificial Sequence
  Description of Artificial Sequence: Synthetic oligonucleotide
ttttatgttaccttttcctg

SEQ ID NO: 4665 - DNA, 19 bp, Artificial Sequence
  Description of Artificial Sequence: Synthetic oligonucleotide
tttgttttctctttttccg

SEQ ID NO: 4666 - DNA, 20 bp, Artificial Sequence
  Description of Artificial Sequence: Synthetic oligonucleotide
tttttttctattcctttccg

SEQ ID NO: 4667 - DNA, 20 bp, Artificial Sequence
  Description of Artificial Sequence: Synthetic oligonucleotide
ttttatttttgcttttccca

SEQ ID NO: 4668 - DNA, 20 bp, Artificial Sequence
  Description of Artificial Sequence: Synthetic oligonucleotide
tttattttctctttgttgtg

SEQ ID NO: 4669 - DNA, 20 bp, Artificial Sequence
  Description of Artificial Sequence: Synthetic oligonucleotide
tcctgtcgttctgccctccc

SEQ ID NO: 4670 - DNA, 20 bp, Artificial Sequence
  Description of Artificial Sequence: Synthetic oligonucleotide
accttactatttcccttccg

SEQ ID NO: 4671 - DNA, 20 bp, Artificial Sequence
  Description of Artificial Sequence: Synthetic oligonucleotide
catttttctctttttgtgcc

SEQ ID NO: 4672 - DNA, 20 bp, Artificial Sequence
  Description of Artificial Sequence: Synthetic oligonucleotide
ttttttgccttctctctccg

SEQ ID NO: 4673 - DNA, 21 bp, Artificial Sequence
  Description of Artificial Sequence: Synthetic oligonucleotide
aattatgtgttttttttgtga

SEQ ID NO: 4674 - DNA, 21 bp, Artificial Sequence
  Description of Artificial Sequence: Synthetic oligonucleotide
tttatttctttccacgttccc

SEQ ID NO: 4675 - DNA, 20 bp, Artificial Sequence
  Description of Artificial Sequence: Synthetic oligonucleotide
tcttttccaactttttgccg

SEQ ID NO: 4676 - DNA, 20 bp, Artificial Sequence
  Description of Artificial Sequence: Synthetic oligonucleotide
actttttaccttttccactg

SEQ ID NO: 4677 - DNA, 21 bp, Artificial Sequence
  Description of Artificial Sequence: Synthetic oligonucleotide
attttgcccagttttttaccg

SEQ ID NO: 4678 - DNA, 20 bp, Artificial Sequence
  Description of Artificial Sequence: Synthetic oligonucleotide
cctttctgttttcctctccg

SEQ ID NO: 4679 - DNA, 21 bp, Artificial Sequence
  Description of Artificial Sequence: Synthetic oligonucleotide
tacttttcttttttttctccg

SEQ ID NO: 4680 - DNA, 20 bp, Artificial Sequence
  Description of Artificial Sequence: Synthetic oligonucleotide
tttcattctcttcttctccg

SEQ ID NO: 4681 - DNA, 20 bp, Artificial Sequence
  Description of Artificial Sequence: Synthetic oligonucleotide
ccgtttgatttccttttccg

SEQ ID NO: 4682 - DNA, 21 bp, Artificial Sequence
  Description of Artificial Sequence: Synthetic oligonucleotide
tatttacgttttttttcaccg

SEQ ID NO: 4683 - DNA, 20 bp, Artificial Sequence
  Description of Artificial Sequence: Synthetic oligonucleotide
ttttttgtggtttgtttccg

SEQ ID NO: 4684 - DNA, 20 bp, Artificial Sequence
  Description of Artificial Sequence: Synthetic oligonucleotide
gatttgtcttttctttggcc

SEQ ID NO: 4685 - DNA, 20 bp, Artificial Sequence
  Description of Artificial Sequence: Synthetic oligonucleotide
cttcattgtttcttttccgc

SEQ ID NO: 4686 - DNA, 20 bp, Artificial Sequence
  Description of Artificial Sequence: Synthetic oligonucleotide
ccatttcttttttccttccg

SEQ ID NO: 4687 - DNA, 20 bp, Artificial Sequence
  Description of Artificial Sequence: Synthetic oligonucleotide
ggttctttcttccttttccg

SEQ ID NO: 4688 - DNA, 20 bp, Artificial Sequence
  Description of Artificial Sequence: Synthetic oligonucleotide
ttttcatttcacttcttgcc

SEQ ID NO: 4689 - DNA, 20 bp, Artificial Sequence
  Description of Artificial Sequence: Synthetic oligonucleotide
cttttcactctatcttaccg

SEQ ID NO: 4690 - DNA, 20 bp, Artificial Sequence
  Description of Artificial Sequence: Synthetic oligonucleotide
tttgggagtagggtgtcccg

SEQ ID NO: 4691 - DNA, 20 bp, Artificial Sequence
  Description of Artificial Sequence: Synthetic oligonucleotide
tattttttgcgctttctccg

SEQ ID NO: 4692 - DNA, 20 bp, Artificial Sequence
  Description of Artificial Sequence: Synthetic oligonucleotide
ttttctttgtttatctcccg

SEQ ID NO: 4693 - DNA, 20 bp, Artificial Sequence
  Description of Artificial Sequence: Synthetic oligonucleotide
tttattatttttcgcttcca

SEQ ID NO: 4694 - DNA, 20 bp, Artificial Sequence
  Description of Artificial Sequence: Synthetic oligonucleotide
tttttctttttctacgtccg

SEQ ID NO: 4695 - DNA, 22 bp, Artificial Sequence
  Description of Artificial Sequence: Synthetic oligonucleotide
tagtgttttttttttttgtgcc

SEQ ID NO: 4696 - DNA, 20 bp, Artificial Sequence
  Description of Artificial Sequence: Synthetic oligonucleotide
tatctcttgtacttcttccg

SEQ ID NO: 4697 - DNA, 21 bp, Artificial Sequence
  Description of Artificial Sequence: Synthetic oligonucleotide
tttttttgttcgctgtttctg

SEQ ID NO: 4698 - DNA, 21 bp, Artificial Sequence
  Description of Artificial Sequence: Synthetic oligonucleotide
ttttgttctttttttcttccg

SEQ ID NO: 4699 - DNA, 20 bp, Artificial Sequence
  Description of Artificial Sequence: Synthetic oligonucleotide
gttgtttcactttttctccg

SEQ ID NO: 4700 - DNA, 20 bp, Artificial Sequence
  Description of Artificial Sequence: Synthetic oligonucleotide
ttttattcctttcttttctg

SEQ ID NO: 4701 - DNA, 20 bp, Artificial Sequence
  Description of Artificial Sequence: Synthetic oligonucleotide
gattctactctttctccccg

SEQ ID NO: 4702 - DNA, 20 bp, Artificial Sequence
  Description of Artificial Sequence: Synthetic oligonucleotide
attgtttctatttttttccg

SEQ ID NO: 4703 - DNA, 20 bp, Artificial Sequence
  Description of Artificial Sequence: Synthetic oligonucleotide
ctttctcactttttttcccg

SEQ ID NO: 4704 - DNA, 20 bp, Artificial Sequence
  Description of Artificial Sequence: Synthetic oligonucleotide
attccacgtttttattaccg

SEQ ID NO: 4705 - DNA, 22 bp, Artificial Sequence
  Description of Artificial Sequence: Synthetic oligonucleotide
tatttacgtttttttttcaccg

SEQ ID NO: 4706 - DNA, 20 bp, Artificial Sequence
  Description of Artificial Sequence: Synthetic oligonucleotide
tttattactgtctttttctg

SEQ ID NO: 4707 - DNA, 21 bp, Artificial Sequence
  Description of Artificial Sequence: Synthetic oligonucleotide
ccatttgttttttttcttccg

SEQ ID NO: 4708 - DNA, 20 bp, Artificial Sequence
  Description of Artificial Sequence: Synthetic oligonucleotide
ttttatcacttctttcgcgt

SEQ ID NO: 4709 - DNA, 20 bp, Artificial Sequence
  Description of Artificial Sequence: Synthetic oligonucleotide
tttttactctgatttttctg

SEQ ID NO: 4710 - DNA, 21 bp, Artificial Sequence
  Description of Artificial Sequence: Synthetic oligonucleotide
tccctgtcgtctgttcgtccc

SEQ ID NO: 4711 - DNA, 21 bp, Artificial Sequence
  Description of Artificial Sequence: Synthetic oligonucleotide
tcctggtcgtctgttcgtccc

SEQ ID NO: 4712 - DNA, 20 bp, Artificial Sequence
  Description of Artificial Sequence: Synthetic oligonucleotide
tacttttgtttgttttgcgc

SEQ ID NO: 4713 - DNA, 20 bp, Artificial Sequence
  Description of Artificial Sequence: Synthetic oligonucleotide
cactttgtttattccctccg

SEQ ID NO: 4714 - DNA, 20 bp, Artificial Sequence
  Description of Artificial Sequence: Synthetic oligonucleotide
tcccttttgtttttccccgc

SEQ ID NO: 4715 - DNA, 20 bp, Artificial Sequence
  Description of Artificial Sequence: Synthetic oligonucleotide
tactctttgttccctttccg

SEQ ID NO: 4716 - DNA, 22 bp, Artificial Sequence
  Description of Artificial Sequence: Synthetic oligonucleotide
tttcctttttttttcccatccg

SEQ ID NO: 4717 - DNA, 21 bp, Artificial Sequence
  Description of Artificial Sequence: Synthetic oligonucleotide
tgtactcactttttttgtccg

SEQ ID NO: 4718 - DNA, 20 bp, Artificial Sequence
  Description of Artificial Sequence: Synthetic oligonucleotide
tcttttgttatttccatccg

SEQ ID NO: 4719 - DNA, 20 bp, Artificial Sequence
  Description of Artificial Sequence: Synthetic oligonucleotide
cttcttctctcttatctccg

SEQ ID NO: 4720 - DNA, 20 bp, Artificial Sequence
  Description of Artificial Sequence: Synthetic oligonucleotide
attcttttatccttgttccg

SEQ ID NO: 4721 - DNA, 20 bp, Artificial Sequence
  Description of Artificial Sequence: Synthetic oligonucleotide
tttcacactttattttgccg

SEQ ID NO: 4722 - DNA, 21 bp, Artificial Sequence
  Description of Artificial Sequence: Synthetic oligonucleotide
tgtctttctagttttttgccg

SEQ ID NO: 4723 - DNA, 21 bp, Artificial Sequence
  Description of Artificial Sequence: Synthetic oligonucleotide
tttggtttttttttttgcccg

SEQ ID NO: 4724 - DNA, 20 bp, Artificial Sequence
  Description of Artificial Sequence: Synthetic oligonucleotide
agtatctatcttttttgccg

SEQ ID NO: 4725 - DNA, 20 bp, Artificial Sequence
  Description of Artificial Sequence: Synthetic oligonucleotide
atctctctaattctcttccg

SEQ ID NO: 4726 - DNA, 20 bp, Artificial Sequence
  Description of Artificial Sequence: Synthetic oligonucleotide
ctttttattatttcttgccc

SEQ ID NO: 4727 - DNA, 20 bp, Artificial Sequence
  Description of Artificial Sequence: Synthetic oligonucleotide
ttttcatgacttattttccc

SEQ ID NO: 4728 - DNA, 20 bp, Artificial Sequence
  Description of Artificial Sequence: Synthetic oligonucleotide
caccttttctctttttaccg

SEQ ID NO: 4729 - DNA, 20 bp, Artificial Sequence
  Description of Artificial Sequence: Synthetic oligonucleotide
atttgctacttttctcaccg

SEQ ID NO: 4730 - DNA, 20 bp, Artificial Sequence
  Description of Artificial Sequence: Synthetic oligonucleotide
atttcgctaattttttaccg

SEQ ID NO: 4731 - DNA, 20 bp, Artificial Sequence
  Description of Artificial Sequence: Synthetic oligonucleotide
tttttctttcgttgcttctg

SEQ ID NO: 4732 - DNA, 20 bp, Artificial Sequence
  Description of Artificial Sequence: Synthetic oligonucleotide
tatttacatttttccttgtg

SEQ ID NO: 4733 - DNA, 20 bp, Artificial Sequence
  Description of Artificial Sequence: Synthetic oligonucleotide
tctcttttgttctttttgcc

SEQ ID NO: 4734 - DNA, 20 bp, Artificial Sequence
  Description of Artificial Sequence: Synthetic oligonucleotide
ttttattctcttttcgccac

SEQ ID NO: 4735 - DNA, 20 bp, Artificial Sequence
  Description of Artificial Sequence: Synthetic oligonucleotide
tacttttctttctctttctg

SEQ ID NO: 4736 - DNA, 22 bp, Artificial Sequence
  Description of Artificial Sequence: Synthetic oligonucleotide
cttttcatttcttttttttccg

SEQ ID NO: 4737 - DNA, 20 bp, Artificial Sequence
  Description of Artificial Sequence: Synthetic oligonucleotide
tttttttccattgttttccg

SEQ ID NO: 4738 - DNA, 21 bp, Artificial Sequence
  Description of Artificial Sequence: Synthetic oligonucleotide
ttttaagttttttcgtttgtg

SEQ ID NO: 4739 - DNA, 20 bp, Artificial Sequence
  Description of Artificial Sequence: Synthetic oligonucleotide
tggagtggggaatcgtctcc

SEQ ID NO: 4740 - DNA, 20 bp, Artificial Sequence
  Description of Artificial Sequence: Synthetic oligonucleotide
aattttgttctttttttgcc

SEQ ID NO: 4741 - DNA, 19 bp, Artificial Sequence
  Description of Artificial Sequence: Synthetic oligonucleotide
ttttcattcttttttcccc

SEQ ID NO: 4742 - DNA, 20 bp, Artificial Sequence
  Description of Artificial Sequence: Synthetic oligonucleotide
tattttatcatttttctccg

SEQ ID NO: 4743 - DNA, 21 bp, Artificial Sequence
  Description of Artificial Sequence: Synthetic oligonucleotide
ttactttgttttttttctccg

SEQ ID NO: 4744 - DNA, 19 bp, Artificial Sequence
  Description of Artificial Sequence: Synthetic oligonucleotide
tttgggttttcccgtgccc

SEQ ID NO: 4745 - DNA, 20 bp, Artificial Sequence
  Description of Artificial Sequence: Synthetic oligonucleotide
tttgggagttgggtgttccg

SEQ ID NO: 4746 - DNA, 20 bp, Artificial Sequence
  Description of Artificial Sequence: Synthetic oligonucleotide
tttggaagtagggtgttccg

SEQ ID NO: 4747 - DNA, 20 bp, Artificial Sequence
  Description of Artificial Sequence: Synthetic oligonucleotide
ttatctctagttttgctccg

SEQ ID NO: 4748 - DNA, 20 bp, Artificial Sequence
  Description of Artificial Sequence: Synthetic oligonucleotide
attcttctattattgttccg

SEQ ID NO: 4749 - DNA, 20 bp, Artificial Sequence
  Description of Artificial Sequence: Synthetic oligonucleotide
cactctgtttcctttctccg

SEQ ID NO: 4750 - DNA, 20 bp, Artificial Sequence
  Description of Artificial Sequence: Synthetic oligonucleotide
tttgggaggagggggttccg

SEQ ID NO: 4751 - DNA, 20 bp, Artificial Sequence
  Description of Artificial Sequence: Synthetic oligonucleotide
tttttcgactttctgctccg

SEQ ID NO: 4752 - DNA, 20 bp, Artificial Sequence
  Description of Artificial Sequence: Synthetic oligonucleotide
cgttttattcttttttcgcc

SEQ ID NO: 4753 - DNA, 20 bp, Artificial Sequence
  Description of Artificial Sequence: Synthetic oligonucleotide
tcattttctactttttcccg

SEQ ID NO: 4754 - DNA, 20 bp, Artificial Sequence
  Description of Artificial Sequence: Synthetic oligonucleotide
ccattttttctttctttccg

SEQ ID NO: 4755 - DNA, 20 bp, Artificial Sequence
  Description of Artificial Sequence: Synthetic oligonucleotide
ttttcattgctcactctccg

SEQ ID NO: 4756 - DNA, 20 bp, Artificial Sequence
  Description of Artificial Sequence: Synthetic oligonucleotide
ctgtatgttggtagccacgc

SEQ ID NO: 4757 - DNA, 20 bp, Artificial Sequence
  Description of Artificial Sequence: Synthetic oligonucleotide
tttcttctacttctcgtccg

SEQ ID NO: 4758 - DNA, 20 bp, Artificial Sequence
  Description of Artificial Sequence: Synthetic oligonucleotide
gtttacttcttctttccccg

SEQ ID NO: 4759 - DNA, 20 bp, Artificial Sequence
  Description of Artificial Sequence: Synthetic oligonucleotide
ttttatcctttatttccctg

SEQ ID NO: 4760 - DNA, 20 bp, Artificial Sequence
  Description of Artificial Sequence: Synthetic oligonucleotide
tgtttattatcttttttcgc

SEQ ID NO: 4761 - DNA, 20 bp, Artificial Sequence
  Description of Artificial Sequence: Synthetic oligonucleotide
ctttttagcttcttttaccg

SEQ ID NO: 4762 - DNA, 18 bp, Artificial Sequence
  Description of Artificial Sequence: Synthetic oligonucleotide
gccttgttctgccctccc

SEQ ID NO: 4763 - DNA, 20 bp, Artificial Sequence
  Description of Artificial Sequence: Synthetic oligonucleotide
ttttctactttcctattgtg

SEQ ID NO: 4764 - DNA, 21 bp, Artificial Sequence
  Description of Artificial Sequence: Synthetic oligonucleotide
acttgttcgttttttttgctg

SEQ ID NO: 4765 - DNA, 20 bp, Artificial Sequence
  Description of Artificial Sequence: Synthetic oligonucleotide
actttttatcttgcttaccc

SEQ ID NO: 4766 - DNA, 20 bp, Artificial Sequence
  Description of Artificial Sequence: Synthetic oligonucleotide
tttactttttattttgcgcc

SEQ ID NO: 4767 - DNA, 20 bp, Artificial Sequence
  Description of Artificial Sequence: Synthetic oligonucleotide
tttttacatgttttctcccg

SEQ ID NO: 4768 - DNA, 22 bp, Artificial Sequence
  Description of Artificial Sequence: Synthetic oligonucleotide
ttttacttcttttttttcgcat

SEQ ID NO: 4769 - DNA, 20 bp, Artificial Sequence
  Description of Artificial Sequence: Synthetic oligonucleotide
atttatctatttttttgctg

SEQ ID NO: 4770 - DNA, 20 bp, Artificial Sequence
  Description of Artificial Sequence: Synthetic oligonucleotide
atcattttctattcttcccg

SEQ ID NO: 4771 - DNA, 20 bp, Artificial Sequence
  Description of Artificial Sequence: Synthetic oligonucleotide
tttcgtaatacctttttccg

SEQ ID NO: 4772 - DNA, 20 bp, Artificial Sequence
  Description of Artificial Sequence: Synthetic oligonucleotide
ttttttgtactttcttcccg

SEQ ID NO: 4773 - DNA, 21 bp, Artificial Sequence
  Description of Artificial Sequence: Synthetic oligonucleotide
tttcttttcattttttttccg

SEQ ID NO: 4774 - DNA, 20 bp, Artificial Sequence
  Description of Artificial Sequence: Synthetic oligonucleotide
tttctattatttcttatctg

SEQ ID NO: 4775 - DNA, 20 bp, Artificial Sequence
  Description of Artificial Sequence: Synthetic oligonucleotide
atttcttttaattcttgccc

SEQ ID NO: 4776 - DNA, 19 bp, Artificial Sequence
  Description of Artificial Sequence: Synthetic oligonucleotide
cttttcatttattttaccg

SEQ ID NO: 4777 - DNA, 20 bp, Artificial Sequence
  Description of Artificial Sequence: Synthetic oligonucleotide
ttttattttatgcgtttccc

SEQ ID NO: 4778 - DNA, 20 bp, Artificial Sequence
  Description of Artificial Sequence: Synthetic oligonucleotide
tttatcatcatttctttccg

SEQ ID NO: 4779 - DNA, 20 bp, Artificial Sequence
  Description of Artificial Sequence: Synthetic oligonucleotide
ctattttttccttttttccg

SEQ ID NO: 4780 - DNA, 20 bp, Artificial Sequence
  Description of Artificial Sequence: Synthetic oligonucleotide
attttttctatttcttaccg

SEQ ID NO: 4781 - DNA, 21 bp, Artificial Sequence
  Description of Artificial Sequence: Synthetic oligonucleotide
tagtgtttttttttttgtgcc

SEQ ID NO: 4782 - DNA, 20 bp, Artificial Sequence
  Description of Artificial Sequence: Synthetic oligonucleotide
gtcttatcttctttttaccg

SEQ ID NO: 4783 - DNA, 20 bp, Artificial Sequence
  Description of Artificial Sequence: Synthetic oligonucleotide
cattttttcatttttctccg

SEQ ID NO: 4784 - DNA, 20 bp, Artificial Sequence
  Description of Artificial Sequence: Synthetic oligonucleotide
tattcttttattctcttgtg

SEQ ID NO: 4785 - DNA, 20 bp, Artificial Sequence
  Description of Artificial Sequence: Synthetic oligonucleotide
tcactacaattttccctccg

SEQ ID NO: 4786 - DNA, 19 bp, Artificial Sequence
  Description of Artificial Sequence: Synthetic oligonucleotide
gatactttttttttgcccc

SEQ ID NO: 4787 - DNA, 20 bp, Artificial Sequence
  Description of Artificial Sequence: Synthetic oligonucleotide
accacttttctctttttccg

SEQ ID NO: 4788 - DNA, 20 bp, Artificial Sequence
  Description of Artificial Sequence: Synthetic oligonucleotide
actcactttttcttcttccg

SEQ ID NO: 4789 - DNA, 20 bp, Artificial Sequence
  Description of Artificial Sequence: Synthetic oligonucleotide
tcttttacttgtccactccg

SEQ ID NO: 4790 - DNA, 20 bp, Artificial Sequence
  Description of Artificial Sequence: Synthetic oligonucleotide
ttatcttcttcattgctccg

SEQ ID NO: 4791 - DNA, 20 bp, Artificial Sequence
  Description of Artificial Sequence: Synthetic oligonucleotide
ggcttttcttctttttgccg

SEQ ID NO: 4792 - DNA, 20 bp, Artificial Sequence
  Description of Artificial Sequence: Synthetic oligonucleotide
ctttttctctttttgtgccg

SEQ ID NO: 4793 - DNA, 20 bp, Artificial Sequence
  Description of Artificial Sequence: Synthetic oligonucleotide
atttatttttttgcgccccg

SEQ ID NO: 4794 - DNA, 20 bp, Artificial Sequence
  Description of Artificial Sequence: Synthetic oligonucleotide
tttttcctacacttattccg

SEQ ID NO: 4795 - DNA, 20 bp, Artificial Sequence
  Description of Artificial Sequence: Synthetic oligonucleotide
ccatctctttttttcctccg

SEQ ID NO: 4796 - DNA, 20 bp, Artificial Sequence
  Description of Artificial Sequence: Synthetic oligonucleotide
ttctactttcttttcatccg

SEQ ID NO: 4797 - DNA, 20 bp, Artificial Sequence
  Description of Artificial Sequence: Synthetic oligonucleotide
ctcattaattcttttctccg

SEQ ID NO: 4798 - DNA, 20 bp, Artificial Sequence
  Description of Artificial Sequence: Synthetic oligonucleotide
ctttttttcgcctatttccg

SEQ ID NO: 4799 - DNA, 20 bp, Artificial Sequence
  Description of Artificial Sequence: Synthetic oligonucleotide
ctctttacttttcttctccg

SEQ ID NO: 4800 - DNA, 20 bp, Artificial Sequence
  Description of Artificial Sequence: Synthetic oligonucleotide
tttgggcgtagggtgttccg

SEQ ID NO: 4801 - DNA, 20 bp, Artificial Sequence
  Description of Artificial Sequence: Synthetic oligonucleotide
ttcctttttcctttgctccg

SEQ ID NO: 4802 - DNA, 20 bp, Artificial Sequence
  Description of Artificial Sequence: Synthetic oligonucleotide
tcattattctttcacatccg

SEQ ID NO: 4803 - DNA, 20 bp, Artificial Sequence
  Description of Artificial Sequence: Synthetic oligonucleotide
tttctcactaatcctttccg

SEQ ID NO: 4804 - DNA, 19 bp, Artificial Sequence
  Description of Artificial Sequence: Synthetic oligonucleotide
attccactttttttcaccg

SEQ ID NO: 4805 - DNA, 22 bp, Artificial Sequence
  Description of Artificial Sequence: Synthetic oligonucleotide
cattatttcttctcgctatccg

SEQ ID NO: 4806 - DNA, 20 bp, Artificial Sequence
  Description of Artificial Sequence: Synthetic oligonucleotide
actttacatcatttttaccg

SEQ ID NO: 4807 - DNA, 20 bp, Artificial Sequence
  Description of Artificial Sequence: Synthetic oligonucleotide
accttatttcttttttgctg

SEQ ID NO: 4808 - DNA, 21 bp, Artificial Sequence
  Description of Artificial Sequence: Synthetic oligonucleotide
ctttcactttttttctctcct

SEQ ID NO: 4809 - DNA, 20 bp, Artificial Sequence
  Description of Artificial Sequence: Synthetic oligonucleotide
ttttcttttcttcctttctg

SEQ ID NO: 4810 - DNA, 20 bp, Artificial Sequence
  Description of Artificial Sequence: Synthetic oligonucleotide
tttttctgtttcgttttccg

SEQ ID NO: 4811 - DNA, 20 bp, Artificial Sequence
  Description of Artificial Sequence: Synthetic oligonucleotide
tttctttattttttgtgcgc

SEQ ID NO: 4812 - DNA, 20 bp, Artificial Sequence
  Description of Artificial Sequence: Synthetic oligonucleotide
tttcatcttttttttttccg

SEQ ID NO: 4813 - DNA, 20 bp, Artificial Sequence
  Description of Artificial Sequence: Synthetic oligonucleotide
tttccgtctttcattttccg

SEQ ID NO: 4814 - DNA, 20 bp, Artificial Sequence
  Description of Artificial Sequence: Synthetic oligonucleotide
ctttatattgcacttttccg

SEQ ID NO: 4815 - DNA, 20 bp, Artificial Sequence
  Description of Artificial Sequence: Synthetic oligonucleotide
tcttcatatttactcttccg

SEQ ID NO: 4816 - DNA, 20 bp, Artificial Sequence
  Description of Artificial Sequence: Synthetic oligonucleotide
ttacttttaatttctttccg

SEQ ID NO: 4817 - DNA, 21 bp, Artificial Sequence
  Description of Artificial Sequence: Synthetic oligonucleotide
tcttttttcattatctccccg

SEQ ID NO: 4818 - DNA, 20 bp, Artificial Sequence
  Description of Artificial Sequence: Synthetic oligonucleotide
ttttttctttttgccttccg

SEQ ID NO: 4819 - DNA, 19 bp, Artificial Sequence
  Description of Artificial Sequence: Synthetic oligonucleotide
attctcttttttcccaccg

SEQ ID NO: 4820 - DNA, 20 bp, Artificial Sequence
  Description of Artificial Sequence: Synthetic oligonucleotide
ttttatttcaatcttctgtg

SEQ ID NO: 4821 - DNA, 20 bp, Artificial Sequence
  Description of Artificial Sequence: Synthetic oligonucleotide
tttactttttactttcccca

SEQ ID NO: 4822 - DNA, 19 bp, Artificial Sequence
  Description of Artificial Sequence: Synthetic oligonucleotide
ctttcgcttttattttccg

SEQ ID NO: 4823 - DNA, 21 bp, Artificial Sequence
  Description of Artificial Sequence: Synthetic oligonucleotide
ttttctctaaatttttctccg

SEQ ID NO: 4824 - DNA, 20 bp, Artificial Sequence
  Description of Artificial Sequence: Synthetic oligonucleotide
ctttactttcttatttcccc

SEQ ID NO: 4825 - DNA, 20 bp, Artificial Sequence
  Description of Artificial Sequence: Synthetic oligonucleotide
ttgtttatttttgttatccc

SEQ ID NO: 4826 - DNA, 20 bp, Artificial Sequence
  Description of Artificial Sequence: Synthetic oligonucleotide
ttcgcttatatttttttccg

SEQ ID NO: 4827 - DNA, 22 bp, Artificial Sequence
  Description of Artificial Sequence: Synthetic oligonucleotide
tctttttttttgtgtttctccg

SEQ ID NO: 4828 - DNA, 22 bp, Artificial Sequence
  Description of Artificial Sequence: Synthetic oligonucleotide
tttggggttttttcccgtgccc

SEQ ID NO: 4829 - DNA, 21 bp, Artificial Sequence
  Description of Artificial Sequence: Synthetic oligonucleotide
tcctgttcgtctgttcgtccc

SEQ ID NO: 4830 - DNA, 19 bp, Artificial Sequence
  Description of Artificial Sequence: Synthetic oligonucleotide
tttgggagtagggtgttcg

SEQ ID NO: 4831 - DNA, 20 bp, Artificial Sequence
  Description of Artificial Sequence: Synthetic oligonucleotide
atttatgttttttcttgccg

SEQ ID NO: 4832 - DNA, 20 bp, Artificial Sequence
  Description of Artificial Sequence: Synthetic oligonucleotide
aattcttatctttttggccg

SEQ ID NO: 4833 - DNA, 20 bp, Artificial Sequence
  Description of Artificial Sequence: Synthetic oligonucleotide
cttttcctatcctttcaccg

SEQ ID NO: 4834 - DNA, 22 bp, Artificial Sequence
  Description of Artificial Sequence: Synthetic oligonucleotide
attcgttttttttcttgttccg

SEQ ID NO: 4835 - DNA, 18 bp, Artificial Sequence
  Description of Artificial Sequence: Synthetic oligonucleotide
attactcttctcttgccg

SEQ ID NO: 4836 - DNA, 21 bp, Artificial Sequence
  Description of Artificial Sequence: Synthetic oligonucleotide
tgttttttttccctttccccg

SEQ ID NO: 4837 - DNA, 20 bp, Artificial Sequence
  Description of Artificial Sequence: Synthetic oligonucleotide
tttctttgcatttctatccg

SEQ ID NO: 4838 - DNA, 22 bp, Artificial Sequence
  Description of Artificial Sequence: Synthetic oligonucleotide
attttctcttttttttctgccg

SEQ ID NO: 4839 - DNA, 20 bp, Artificial Sequence
  Description of Artificial Sequence: Synthetic oligonucleotide
atctcgctcaattttctccg

SEQ ID NO: 4840 - DNA, 20 bp, Artificial Sequence
  Description of Artificial Sequence: Synthetic oligonucleotide
ttctttacatctcctttccg

SEQ ID NO: 4841 - DNA, 20 bp, Artificial Sequence
  Description of Artificial Sequence: Synthetic oligonucleotide
tctttctctcttttgctccg

SEQ ID NO: 4842 - DNA, 20 bp, Artificial Sequence
  Description of Artificial Sequence: Synthetic oligonucleotide
ttcctatttcgttctttccg

SEQ ID NO: 4843 - DNA, 20 bp, Artificial Sequence
  Description of Artificial Sequence: Synthetic oligonucleotide
ttactttctttttcccaccc

SEQ ID NO: 4844 - DNA, 20 bp, Artificial Sequence
  Description of Artificial Sequence: Synthetic oligonucleotide
ctctttcttttatccttccg

SEQ ID NO: 4845 - DNA, 20 bp, Artificial Sequence
  Description of Artificial Sequence: Synthetic oligonucleotide
cattattttttttccctcgg

SEQ ID NO: 4846 - DNA, 20 bp, Artificial Sequence
  Description of Artificial Sequence: Synthetic oligonucleotide
acttttcttggtttttcccg

SEQ ID NO: 4847 - DNA, 20 bp, Artificial Sequence
  Description of Artificial Sequence: Synthetic oligonucleotide
tcttttttgtttttctgccg

SEQ ID NO: 4848 - DNA, 20 bp, Artificial Sequence
  Description of Artificial Sequence: Synthetic oligonucleotide
tttttcactatgcttttctg

SEQ ID NO: 4849 - DNA, 20 bp, Artificial Sequence
  Description of Artificial Sequence: Synthetic oligonucleotide
tattttttcttcttcttgtg

SEQ ID NO: 4850 - DNA, 20 bp, Artificial Sequence
  Description of Artificial Sequence: Synthetic oligonucleotide
ttcttgttcttattcatccg

SEQ ID NO: 4851 - DNA, 20 bp, Artificial Sequence
  Description of Artificial Sequence: Synthetic oligonucleotide
tctttacttaaatttctccg

SEQ ID NO: 4852 - DNA, 20 bp, Artificial Sequence
  Description of Artificial Sequence: Synthetic oligonucleotide
ttctctatttgttctttccg

SEQ ID NO: 4853 - DNA, 22 bp, Artificial Sequence
  Description of Artificial Sequence: Synthetic oligonucleotide
aattgctcttttttttctaccg

SEQ ID NO: 4854 - DNA, 20 bp, Artificial Sequence
  Description of Artificial Sequence: Synthetic oligonucleotide
atatttcacgttttttactg

SEQ ID NO: 4855 - DNA, 20 bp, Artificial Sequence
  Description of Artificial Sequence: Synthetic oligonucleotide
attttcagtttgtttcaccg

SEQ ID NO: 4856 - DNA, 20 bp, Artificial Sequence
  Description of Artificial Sequence: Synthetic oligonucleotide
cttctctacttttctttccg

SEQ ID NO: 4857 - DNA, 20 bp, Artificial Sequence
  Description of Artificial Sequence: Synthetic oligonucleotide
actttttacttctttcaccg

SEQ ID NO: 4858 - DNA, 20 bp, Artificial Sequence
  Description of Artificial Sequence: Synthetic oligonucleotide
tttctattttattttgtgtg

SEQ ID NO: 4859 - DNA, 20 bp, Artificial Sequence
  Description of Artificial Sequence: Synthetic oligonucleotide
ttttactttagctttttccc

SEQ ID NO: 4860 - DNA, 20 bp, Artificial Sequence
  Description of Artificial Sequence: Synthetic oligonucleotide
ttcattttttattccctgtg

SEQ ID NO: 4861 - DNA, 20 bp, Artificial Sequence
  Description of Artificial Sequence: Synthetic oligonucleotide
actttttctttcttatcccc

SEQ ID NO: 4862 - DNA, 20 bp, Artificial Sequence
  Description of Artificial Sequence: Synthetic oligonucleotide
ttttatctttttcatttccc

SEQ ID NO: 4863 - DNA, 20 bp, Artificial Sequence
  Description of Artificial Sequence: Synthetic oligonucleotide
gtcttactatttcttttccg

SEQ ID NO: 4864 - DNA, 21 bp, Artificial Sequence
  Description of Artificial Sequence: Synthetic oligonucleotide
tctttttttttgtttcccccg

SEQ ID NO: 4865 - DNA, 20 bp, Artificial Sequence
  Description of Artificial Sequence: Synthetic oligonucleotide
ttttattctttcctttacgc

SEQ ID NO: 4866 - DNA, 20 bp, Artificial Sequence
  Description of Artificial Sequence: Synthetic oligonucleotide
tttttctcttcctttgtccg

SEQ ID NO: 4867 - DNA, 22 bp, Artificial Sequence
  Description of Artificial Sequence: Synthetic oligonucleotide
attcggtcttttttttgctccg

SEQ ID NO: 4868 - DNA, 20 bp, Artificial Sequence
  Description of Artificial Sequence: Synthetic oligonucleotide
attgggagtagggtgttccg

SEQ ID NO: 4869 - DNA, 20 bp, Artificial Sequence
  Description of Artificial Sequence: Synthetic oligonucleotide
attatattctctctctgccg

SEQ ID NO: 4870 - DNA, 21 bp, Artificial Sequence
  Description of Artificial Sequence: Synthetic oligonucleotide
acttctttttttgttttgccg

SEQ ID NO: 4871 - DNA, 20 bp, Artificial Sequence
  Description of Artificial Sequence: Synthetic oligonucleotide
gtttatctccttttttgccc

SEQ ID NO: 4872 - DNA, 20 bp, Artificial Sequence
  Description of Artificial Sequence: Synthetic oligonucleotide
ttctctgttcctttctgccg

SEQ ID NO: 4873 - DNA, 20 bp, Artificial Sequence
  Description of Artificial Sequence: Synthetic oligonucleotide
gatggtggtgtagggtaccg

SEQ ID NO: 4874 - DNA, 20 bp, Artificial Sequence
  Description of Artificial Sequence: Synthetic oligonucleotide
tttcttacttcctcgttccg

SEQ ID NO: 4875 - DNA, 20 bp, Artificial Sequence
  Description of Artificial Sequence: Synthetic oligonucleotide
tttttctctctacatttccg

SEQ ID NO: 4876 - DNA, 20 bp, Artificial Sequence
  Description of Artificial Sequence: Synthetic oligonucleotide
ttattttccgccttttgccg

SEQ ID NO: 4877 - DNA, 20 bp, Artificial Sequence
  Description of Artificial Sequence: Synthetic oligonucleotide
ttctctattttttcttgccg

SEQ ID NO: 4878 - DNA, 20 bp, Artificial Sequence
  Description of Artificial Sequence: Synthetic oligonucleotide
acattatcctgcatgtaccg

SEQ ID NO: 4879 - DNA, 21 bp, Artificial Sequence
  Description of Artificial Sequence: Synthetic oligonucleotide
atctttctttctttctgtccg

SEQ ID NO: 4880 - DNA, 20 bp, Artificial Sequence
  Description of Artificial Sequence: Synthetic oligonucleotide
ttttctatttgttgcttccg

SEQ ID NO: 4881 - DNA, 20 bp, Artificial Sequence
  Description of Artificial Sequence: Synthetic oligonucleotide
tttacattttctcctctccg

SEQ ID NO: 4882 - DNA, 20 bp, Artificial Sequence
  Description of Artificial Sequence: Synthetic oligonucleotide
tattcttatgttactttccg

SEQ ID NO: 4883 - DNA, 19 bp, Artificial Sequence
  Description of Artificial Sequence: Synthetic oligonucleotide
cattcttttttctcctgtg

SEQ ID NO: 4884 - DNA, 20 bp, Artificial Sequence
  Description of Artificial Sequence: Synthetic oligonucleotide
ctttattttcggttttaccg

SEQ ID NO: 4885 - DNA, 20 bp, Artificial Sequence
  Description of Artificial Sequence: Synthetic oligonucleotide
ctcttttttctccatatccg

SEQ ID NO: 4886 - DNA, 20 bp, Artificial Sequence
  Description of Artificial Sequence: Synthetic oligonucleotide
ctctctctttgttttctccg

SEQ ID NO: 4887 - DNA, 19 bp, Artificial Sequence
  Description of Artificial Sequence: Synthetic oligonucleotide
attcttgttttttttgccg

SEQ ID NO: 4888 - DNA, 20 bp, Artificial Sequence
  Description of Artificial Sequence: Synthetic oligonucleotide
attcgttttttcttgttccg

SEQ ID NO: 4889 - DNA, 20 bp, Artificial Sequence
  Description of Artificial Sequence: Synthetic oligonucleotide
attttccctttcttactccg

SEQ ID NO: 4890 - DNA, 22 bp, Artificial Sequence
  Description of Artificial Sequence: Synthetic oligonucleotide
ctttattttttgttttttgccc

SEQ ID NO: 4891 - DNA, 20 bp, Artificial Sequence
  Description of Artificial Sequence: Synthetic oligonucleotide
tttgggagtagggtgttcca

SEQ ID NO: 4892 - DNA, 20 bp, Artificial Sequence
  Description of Artificial Sequence: Synthetic oligonucleotide
tttttcctttcctttgtccg

SEQ ID NO: 4893 - DNA, 20 bp, Artificial Sequence
  Description of Artificial Sequence: Synthetic oligonucleotide
acctttaattactccttccg

SEQ ID NO: 4894 - DNA, 19 bp, Artificial Sequence
  Description of Artificial Sequence: Synthetic oligonucleotide
tttccacggtttttttccg

SEQ ID NO: 4895 - DNA, 20 bp, Artificial Sequence
  Description of Artificial Sequence: Synthetic oligonucleotide
ttctttataattattctccg

SEQ ID NO: 4896 - DNA, 20 bp, Artificial Sequence
  Description of Artificial Sequence: Synthetic oligonucleotide
gttcttaattcttttcaccg

SEQ ID NO: 4897 - DNA, 21 bp, Artificial Sequence
  Description of Artificial Sequence: Synthetic oligonucleotide
tttttcattcccttttttccg

SEQ ID NO: 4898 - DNA, 20 bp, Artificial Sequence
  Description of Artificial Sequence: Synthetic oligonucleotide
tttttctattactttctgcc

SEQ ID NO: 4899 - DNA, 20 bp, Artificial Sequence
  Description of Artificial Sequence: Synthetic oligonucleotide
tcctttatttctcttcgccg

SEQ ID NO: 4900 - DNA, 20 bp, Artificial Sequence
  Description of Artificial Sequence: Synthetic oligonucleotide
cacttatcttattctctccg

SEQ ID NO: 4901 - DNA, 20 bp, Artificial Sequence
  Description of Artificial Sequence: Synthetic oligonucleotide
tttccgttcttcttcatccg

SEQ ID NO: 4902 - DNA, 20 bp, Artificial Sequence
  Description of Artificial Sequence: Synthetic oligonucleotide
ttttctcgcttctatgtccg

SEQ ID NO: 4903 - DNA, 19 bp, Artificial Sequence
  Description of Artificial Sequence: Synthetic oligonucleotide
tttttatggtttgtttccg

SEQ ID NO: 4904 - DNA, 20 bp, Artificial Sequence
  Description of Artificial Sequence: Synthetic oligonucleotide
atctttctcttcttgtcccg

SEQ ID NO: 4905 - DNA, 20 bp, Artificial Sequence
  Description of Artificial Sequence: Synthetic oligonucleotide
tttttcgctgtctttttccg

SEQ ID NO: 4906 - DNA, 20 bp, Artificial Sequence
  Description of Artificial Sequence: Synthetic oligonucleotide
tgtttattcttgtttgtccg

SEQ ID NO: 4907 - DNA, 19 bp, Artificial Sequence
  Description of Artificial Sequence: Synthetic oligonucleotide
tctcttctttattcttccg

SEQ ID NO: 4908 - DNA, 20 bp, Artificial Sequence
  Description of Artificial Sequence: Synthetic oligonucleotide
aatttcattctctttttgcc

SEQ ID NO: 4909 - DNA, 20 bp, Artificial Sequence
  Description of Artificial Sequence: Synthetic oligonucleotide
cttttatcacattctttccg

SEQ ID NO: 4910 - DNA, 20 bp, Artificial Sequence
  Description of Artificial Sequence: Synthetic oligonucleotide
gcatttcttttcccttaccg

SEQ ID NO: 4911 - DNA, 20 bp, Artificial Sequence
  Description of Artificial Sequence: Synthetic oligonucleotide
tccatgttgttttttttccg

SEQ ID NO: 4912 - DNA, 20 bp, Artificial Sequence
  Description of Artificial Sequence: Synthetic oligonucleotide
catttttcattccttttccg

SEQ ID NO: 4913 - DNA, 20 bp, Artificial Sequence
  Description of Artificial Sequence: Synthetic oligonucleotide
attttctttgctttattctg

SEQ ID NO: 4914 - DNA, 18 bp, Artificial Sequence
  Description of Artificial Sequence: Synthetic oligonucleotide
ctttcgttctgccctccc

SEQ ID NO: 4915 - DNA, 20 bp, Artificial Sequence
  Description of Artificial Sequence: Synthetic oligonucleotide
actttttttcctcttacccg

SEQ ID NO: 4916 - DNA, 20 bp, Artificial Sequence
  Description of Artificial Sequence: Synthetic oligonucleotide
aaccttgttttctttcaccg

SEQ ID NO: 4917 - DNA, 20 bp, Artificial Sequence
  Description of Artificial Sequence: Synthetic oligonucleotide
gtttttctttactctttccc

SEQ ID NO: 4918 - DNA, 21 bp, Artificial Sequence
  Description of Artificial Sequence: Synthetic oligonucleotide
atttttttctttcctttgccg

SEQ ID NO: 4919 - DNA, 21 bp, Artificial Sequence
  Description of Artificial Sequence: Synthetic oligonucleotide
tttgtaatgtttttttttccg

SEQ ID NO: 4920 - DNA, 21 bp, Artificial Sequence
  Description of Artificial Sequence: Synthetic oligonucleotide
ttttttcattccctttttccg

SEQ ID NO: 4921 - DNA, 20 bp, Artificial Sequence
  Description of Artificial Sequence: Synthetic oligonucleotide
ctttctataattattctccg

SEQ ID NO: 4922 - DNA, 20 bp, Artificial Sequence
  Description of Artificial Sequence: Synthetic oligonucleotide
tttattgtttatttgttcca

SEQ ID NO: 4923 - DNA, 20 bp, Artificial Sequence
  Description of Artificial Sequence: Synthetic oligonucleotide
tgttttttggtttttttgcg

SEQ ID NO: 4924 - DNA, 22 bp, Artificial Sequence
  Description of Artificial Sequence: Synthetic oligonucleotide
ttcgtacttttttttttttccg

SEQ ID NO: 4925 - DNA, 20 bp, Artificial Sequence
  Description of Artificial Sequence: Synthetic oligonucleotide
tttttggttatatttctccg

SEQ ID NO: 4926 - DNA, 20 bp, Artificial Sequence
  Description of Artificial Sequence: Synthetic oligonucleotide
ttttatttccatttttgcac

SEQ ID NO: 4927 - DNA, 20 bp, Artificial Sequence
  Description of Artificial Sequence: Synthetic oligonucleotide
ttcattttagttttttcccc

SEQ ID NO: 4928 - DNA, 20 bp, Artificial Sequence
  Description of Artificial Sequence: Synthetic oligonucleotide
ccttactatacttttttccg

SEQ ID NO: 4929 - DNA, 20 bp, Artificial Sequence
  Description of Artificial Sequence: Synthetic oligonucleotide
ttaaggagaagggtggtacg

SEQ ID NO: 4930 - DNA, 21 bp, Artificial Sequence
  Description of Artificial Sequence: Synthetic oligonucleotide
tttttcatacctttttttccg

SEQ ID NO: 4931 - DNA, 21 bp, Artificial Sequence
  Description of Artificial Sequence: Synthetic oligonucleotide
tttttgttggtgttttttccg

SEQ ID NO: 4932 - DNA, 20 bp, Artificial Sequence
  Description of Artificial Sequence: Synthetic oligonucleotide
tattttttccttgttttctg

SEQ ID NO: 4933 - DNA, 20 bp, Artificial Sequence
  Description of Artificial Sequence: Synthetic oligonucleotide
tttttcatttattacttctg

SEQ ID NO: 4934 - DNA, 18 bp, Artificial Sequence
  Description of Artificial Sequence: Synthetic oligonucleotide
tcctgtcgtctttgtccc

SEQ ID NO: 4935 - DNA, 21 bp, Artificial Sequence
  Description of Artificial Sequence: Synthetic oligonucleotide
aattatgtttttttgtgaccg

SEQ ID NO: 4936 - DNA, 18 bp, Artificial Sequence
  Description of Artificial Sequence: Synthetic oligonucleotide
tcctgtcgtctctgtccc

SEQ ID NO: 4937 - DNA, 20 bp, Artificial Sequence
  Description of Artificial Sequence: Synthetic oligonucleotide
tgctttctcatttctttccg

SEQ ID NO: 4938 - DNA, 21 bp, Artificial Sequence
  Description of Artificial Sequence: Synthetic oligonucleotide
aattatgtgtttttttgaccg

SEQ ID NO: 4939 - DNA, 19 bp, Artificial Sequence
  Description of Artificial Sequence: Synthetic oligonucleotide
cataggagtagggtggtgc

SEQ ID NO: 4940 - DNA, 20 bp, Artificial Sequence
  Description of Artificial Sequence: Synthetic oligonucleotide
tttcttctactatctatccg

SEQ ID NO: 4941 - DNA, 20 bp, Artificial Sequence
  Description of Artificial Sequence: Synthetic oligonucleotide
atccattatacttttctccg

SEQ ID NO: 4942 - DNA, 20 bp, Artificial Sequence
  Description of Artificial Sequence: Synthetic oligonucleotide
tttgggagtagagtgttccg

SEQ ID NO: 4943 - DNA, 20 bp, Artificial Sequence
  Description of Artificial Sequence: Synthetic oligonucleotide
gttttccttttccctttgcc

SEQ ID NO: 4944 - DNA, 20 bp, Artificial Sequence
  Description of Artificial Sequence: Synthetic oligonucleotide
tcattttattttttcttccg

SEQ ID NO: 4945 - DNA, 20 bp, Artificial Sequence
  Description of Artificial Sequence: Synthetic oligonucleotide
tagttttcctttcttttccg

SEQ ID NO: 4946 - DNA, 20 bp, Artificial Sequence
  Description of Artificial Sequence: Synthetic oligonucleotide
agatttgttttttgtggccg

SEQ ID NO: 4947 - DNA, 20 bp, Artificial Sequence
  Description of Artificial Sequence: Synthetic oligonucleotide
tcctttaattttctttgccg

SEQ ID NO: 4948 - DNA, 20 bp, Artificial Sequence
  Description of Artificial Sequence: Synthetic oligonucleotide
attggtgtaggggggttccg

SEQ ID NO: 4949 - DNA, 20 bp, Artificial Sequence
  Description of Artificial Sequence: Synthetic oligonucleotide
ttatcttgttctttcatccc

SEQ ID NO: 4950 - DNA, 20 bp, Artificial Sequence
  Description of Artificial Sequence: Synthetic oligonucleotide
tttttctcattttcttaccg

SEQ ID NO: 4951 - DNA, 20 bp, Artificial Sequence
  Description of Artificial Sequence: Synthetic oligonucleotide
attcttttcttttttcgctg

SEQ ID NO: 4952 - DNA, 20 bp, Artificial Sequence
  Description of Artificial Sequence: Synthetic oligonucleotide
attttttcattccttttccg

SEQ ID NO: 4953 - DNA, 21 bp, Artificial Sequence
  Description of Artificial Sequence: Synthetic oligonucleotide
agtttcatgtttttttgtccc

SEQ ID NO: 4954 - DNA, 20 bp, Artificial Sequence
  Description of Artificial Sequence: Synthetic oligonucleotide
acttttcatttcatttgccg

SEQ ID NO: 4955 - DNA, 20 bp, Artificial Sequence
  Description of Artificial Sequence: Synthetic oligonucleotide
atttcaatgttctttctccg

SEQ ID NO: 4956 - DNA, 19 bp, Artificial Sequence
  Description of Artificial Sequence: Synthetic oligonucleotide
tcttgtttttttttggccc

SEQ ID NO: 4957 - DNA, 19 bp, Artificial Sequence
  Description of Artificial Sequence: Synthetic oligonucleotide
tttctcttatcttctgccg

SEQ ID NO: 4958 - DNA, 20 bp, Artificial Sequence
  Description of Artificial Sequence: Synthetic oligonucleotide
ttttccttcttttccttccg

SEQ ID NO: 4959 - DNA, 19 bp, Artificial Sequence
  Description of Artificial Sequence: Synthetic oligonucleotide
tttcacactttttttgctg

SEQ ID NO: 4960 - DNA, 20 bp, Artificial Sequence
  Description of Artificial Sequence: Synthetic oligonucleotide
ttccttaatttctttccccg

SEQ ID NO: 4961 - DNA, 20 bp, Artificial Sequence
  Description of Artificial Sequence: Synthetic oligonucleotide
agttttgactctcttttccg

SEQ ID NO: 4962 - DNA, 19 bp, Artificial Sequence
  Description of Artificial Sequence: Synthetic oligonucleotide
cttgtgttttttttttgcc

SEQ ID NO: 4963 - DNA, 20 bp, Artificial Sequence
  Description of Artificial Sequence: Synthetic oligonucleotide
tttatatgtttctttccccg

SEQ ID NO: 4964 - DNA, 20 bp, Artificial Sequence
  Description of Artificial Sequence: Synthetic oligonucleotide
catttttccttcttcttcgc

SEQ ID NO: 4965 - DNA, 20 bp, Artificial Sequence
  Description of Artificial Sequence: Synthetic oligonucleotide
tttttctatgtttatttctg

SEQ ID NO: 4966 - DNA, 20 bp, Artificial Sequence
  Description of Artificial Sequence: Synthetic oligonucleotide
gtatttttgttcttctcccg

SEQ ID NO: 4967 - DNA, 20 bp, Artificial Sequence
  Description of Artificial Sequence: Synthetic oligonucleotide
tttatctttaatttcccccg

SEQ ID NO: 4968 - DNA, 20 bp, Artificial Sequence
  Description of Artificial Sequence: Synthetic oligonucleotide
attctttatctctttttgcc

SEQ ID NO: 4969 - DNA, 20 bp, Artificial Sequence
  Description of Artificial Sequence: Synthetic oligonucleotide
ttttcttattttcacatccc

SEQ ID NO: 4970 - DNA, 20 bp, Artificial Sequence
  Description of Artificial Sequence: Synthetic oligonucleotide
tcttgtatttttgttatccg

SEQ ID NO: 4971 - DNA, 20 bp, Artificial Sequence
  Description of Artificial Sequence: Synthetic oligonucleotide
tttttactattttacttctg

SEQ ID NO: 4972 - DNA, 20 bp, Artificial Sequence
  Description of Artificial Sequence: Synthetic oligonucleotide
tttctttacttttacctctg

SEQ ID NO: 4973 - DNA, 21 bp, Artificial Sequence
  Description of Artificial Sequence: Synthetic oligonucleotide
tgtttttgtttatttttgccg

SEQ ID NO: 4974 - DNA, 19 bp, Artificial Sequence
  Description of Artificial Sequence: Synthetic oligonucleotide
tcttttttcactttctccg

SEQ ID NO: 4975 - DNA, 20 bp, Artificial Sequence
  Description of Artificial Sequence: Synthetic oligonucleotide
atcactattttttttcaccg

SEQ ID NO: 4976 - DNA, 20 bp, Artificial Sequence
  Description of Artificial Sequence: Synthetic oligonucleotide
catatttcttcttttttccg

SEQ ID NO: 4977 - DNA, 20 bp, Artificial Sequence
  Description of Artificial Sequence: Synthetic oligonucleotide
ctctttcttttcatcttccg

SEQ ID NO: 4978 - DNA, 20 bp, Artificial Sequence
  Description of Artificial Sequence: Synthetic oligonucleotide
ttattttattcttctctctg

SEQ ID NO: 4979 - DNA, 20 bp, Artificial Sequence
  Description of Artificial Sequence: Synthetic oligonucleotide
atctctttcacttattaccg

SEQ ID NO: 4980 - DNA, 21 bp, Artificial Sequence
  Description of Artificial Sequence: Synthetic oligonucleotide
tttttttagttattctctccg

SEQ ID NO: 4981 - DNA, 21 bp, Artificial Sequence
  Description of Artificial Sequence: Synthetic oligonucleotide
tctttttttgtttttccgccg

SEQ ID NO: 4982 - DNA, 22 bp, Artificial Sequence
  Description of Artificial Sequence: Synthetic oligonucleotide
tttccacggttttttttttccg

SEQ ID NO: 4983 - DNA, 21 bp, Artificial Sequence
  Description of Artificial Sequence: Synthetic oligonucleotide
ttattttttttgtttgttgtg

SEQ ID NO: 4984 - DNA, 20 bp, Artificial Sequence
  Description of Artificial Sequence: Synthetic oligonucleotide
tccttgtcgtcttgcgttcc

SEQ ID NO: 4985 - DNA, 20 bp, Artificial Sequence
  Description of Artificial Sequence: Synthetic oligonucleotide
aaaggaggagttgggatccg

SEQ ID NO: 4986 - DNA, 19 bp, Artificial Sequence
  Description of Artificial Sequence: Synthetic oligonucleotide
aattatgtgtttgtgaccg

SEQ ID NO: 4987 - DNA, 20 bp, Artificial Sequence
  Description of Artificial Sequence: Synthetic oligonucleotide
tttgggagtagggtggtccg

SEQ ID NO: 4988 - DNA, 20 bp, Artificial Sequence
  Description of Artificial Sequence: Synthetic oligonucleotide
tttctactatgccctttccg

SEQ ID NO: 4989 - DNA, 20 bp, Artificial Sequence
  Description of Artificial Sequence: Synthetic oligonucleotide
cgttatttctctttttgctg

SEQ ID NO: 4990 - DNA, 20 bp, Artificial Sequence
  Description of Artificial Sequence: Synthetic oligonucleotide
tcacgttctcctagtccccc

SEQ ID NO: 4991 - DNA, 20 bp, Artificial Sequence
  Description of Artificial Sequence: Synthetic oligonucleotide
gtttcctcgttttctctccg

SEQ ID NO: 4992 - DNA, 22 bp, Artificial Sequence
  Description of Artificial Sequence: Synthetic oligonucleotide
tactttccttatttgctctccg

SEQ ID NO: 4993 - DNA, 20 bp, Artificial Sequence
  Description of Artificial Sequence: Synthetic oligonucleotide
cgttcattttcttcttaccg

SEQ ID NO: 4994 - DNA, 20 bp, Artificial Sequence
  Description of Artificial Sequence: Synthetic oligonucleotide
cttttcctctttcttctgcc

SEQ ID NO: 4995 - DNA, 20 bp, Artificial Sequence
  Description of Artificial Sequence: Synthetic oligonucleotide
tcttttcgtacttgcttccg

SEQ ID NO: 4996 - DNA, 20 bp, Artificial Sequence
  Description of Artificial Sequence: Synthetic oligonucleotide
ctttcttgaccctttctccg

SEQ ID NO: 4997 - DNA, 20 bp, Artificial Sequence
  Description of Artificial Sequence: Synthetic oligonucleotide
tttgggagtagtgtgttccg

SEQ ID NO: 4998 - DNA, 20 bp, Artificial Sequence
  Description of Artificial Sequence: Synthetic oligonucleotide
agtttcatgttttttgtccc

SEQ ID NO: 4999 - DNA, 20 bp, Artificial Sequence
  Description of Artificial Sequence: Synthetic oligonucleotide
attcgttttcattattaccg

SEQ ID NO: 5000 - DNA, 20 bp, Artificial Sequence
  Description of Artificial Sequence: Synthetic oligonucleotide
tcacttttcctttatccccg

SEQ ID NO: 5001 - DNA, 21 bp, Artificial Sequence
  Description of Artificial Sequence: Synthetic oligonucleotide
attccactttttttttcaccg

SEQ ID NO: 5002 - DNA, 20 bp, Artificial Sequence
  Description of Artificial Sequence: Synthetic oligonucleotide
cttttttgtatttgtttccg

SEQ ID NO: 5003 - DNA, 19 bp, Artificial Sequence
  Description of Artificial Sequence: Synthetic oligonucleotide
tttggtttttttttgcccg

SEQ ID NO: 5004 - DNA, 20 bp, Artificial Sequence
  Description of Artificial Sequence: Synthetic oligonucleotide
tctttttattttcctcggcc

SEQ ID NO: 5005 - DNA, 20 bp, Artificial Sequence
  Description of Artificial Sequence: Synthetic oligonucleotide
tgttttgtttttttgtcccc

SEQ ID NO: 5006 - DNA, 21 bp, Artificial Sequence
  Description of Artificial Sequence: Synthetic oligonucleotide
tttttttcctcgcttttgccg

SEQ ID NO: 5007 - DNA, 20 bp, Artificial Sequence
  Description of Artificial Sequence: Synthetic oligonucleotide
gttatttacctttttttccg

SEQ ID NO: 5008 - DNA, 20 bp, Artificial Sequence
  Description of Artificial Sequence: Synthetic oligonucleotide
ctctttaaaattctcttccg

SEQ ID NO: 5009 - DNA, 20 bp, Artificial Sequence
  Description of Artificial Sequence: Synthetic oligonucleotide
tattttctttttcttcgcac

SEQ ID NO: 5010 - DNA, 20 bp, Artificial Sequence
  Description of Artificial Sequence: Synthetic oligonucleotide
tttatttcttattgtttgcg

SEQ ID NO: 5011 - DNA, 20 bp, Artificial Sequence
  Description of Artificial Sequence: Synthetic oligonucleotide
gtttttacttttttactccc

SEQ ID NO: 5012 - DNA, 20 bp, Artificial Sequence
  Description of Artificial Sequence: Synthetic oligonucleotide
cttctatattttctactccg

SEQ ID NO: 5013 - DNA, 20 bp, Artificial Sequence
  Description of Artificial Sequence: Synthetic oligonucleotide
tttctttacttactctcccg

SEQ ID NO: 5014 - DNA, 20 bp, Artificial Sequence
  Description of Artificial Sequence: Synthetic oligonucleotide
gtttatgtttacctttcgtc

SEQ ID NO: 5015 - DNA, 20 bp, Artificial Sequence
  Description of Artificial Sequence: Synthetic oligonucleotide
atattttatctcttttcccg

SEQ ID NO: 5016 - DNA, 20 bp, Artificial Sequence
  Description of Artificial Sequence: Synthetic oligonucleotide
acactattttcctttttccc

SEQ ID NO: 5017 - DNA, 20 bp, Artificial Sequence
  Description of Artificial Sequence: Synthetic oligonucleotide
atcttcttgactctttaccg

SEQ ID NO: 5018 - DNA, 20 bp, Artificial Sequence
  Description of Artificial Sequence: Synthetic oligonucleotide
ccttttttctatcctttccg

SEQ ID NO: 5019 - DNA, 20 bp, Artificial Sequence
  Description of Artificial Sequence: Synthetic oligonucleotide
tcttcaggtttatttttccg

SEQ ID NO: 5020 - DNA, 20 bp, Artificial Sequence
  Description of Artificial Sequence: Synthetic oligonucleotide
tttctattaatccttttctg

SEQ ID NO: 5021 - DNA, 19 bp, Artificial Sequence
  Description of Artificial Sequence: Synthetic oligonucleotide
tacttttcttttttctccg

SEQ ID NO: 5022 - DNA, 20 bp, Artificial Sequence
  Description of Artificial Sequence: Synthetic oligonucleotide
tcttgtcttaatttttcccg

SEQ ID NO: 5023 - DNA, 20 bp, Artificial Sequence
  Description of Artificial Sequence: Synthetic oligonucleotide
gtttttctttttccttaccg

SEQ ID NO: 5024 - DNA, 19 bp, Artificial Sequence
  Description of Artificial Sequence: Synthetic oligonucleotide
gtttgttcttttttttccg

SEQ ID NO: 5025 - DNA, 20 bp, Artificial Sequence
  Description of Artificial Sequence: Synthetic oligonucleotide
ttttgttctgttattttccc

SEQ ID NO: 5026 - DNA, 20 bp, Artificial Sequence
  Description of Artificial Sequence: Synthetic oligonucleotide
tgttttatttatcctttcgc

SEQ ID NO: 5027 - DNA, 20 bp, Artificial Sequence
  Description of Artificial Sequence: Synthetic oligonucleotide
gttgttttaatgtttttccc

SEQ ID NO: 5028 - DNA, 20 bp, Artificial Sequence
  Description of Artificial Sequence: Synthetic oligonucleotide
gattctcttatttcttaccc

SEQ ID NO: 5029 - DNA, 18 bp, Artificial Sequence
  Description of Artificial Sequence: Synthetic oligonucleotide
ttttactttttttttgtg

SEQ ID NO: 5030 - DNA, 20 bp, Artificial Sequence
  Description of Artificial Sequence: Synthetic oligonucleotide
ttttatttcttctttgtgtc

SEQ ID NO: 5031 - DNA, 22 bp, Artificial Sequence
  Description of Artificial Sequence: Synthetic oligonucleotide
tttattctgttttttttttccg

SEQ ID NO: 5032 - DNA, 20 bp, Artificial Sequence
  Description of Artificial Sequence: Synthetic oligonucleotide
ctttctaatctatttttccg

SEQ ID NO: 5033 - DNA, 20 bp, Artificial Sequence
  Description of Artificial Sequence: Synthetic oligonucleotide
tttggggttttcccgtcccc

SEQ ID NO: 5034 - DNA, 18 bp, Artificial Sequence
  Description of Artificial Sequence: Synthetic oligonucleotide
tcctgtcgtgttcgtccc

SEQ ID NO: 5035 - DNA, 20 bp, Artificial Sequence
  Description of Artificial Sequence: Synthetic oligonucleotide
tccttgtcgtcttgcgcccc

SEQ ID NO: 5036 - DNA, 20 bp, Artificial Sequence
  Description of Artificial Sequence: Synthetic oligonucleotide
gttggtgtagggaggttccg

SEQ ID NO: 5037 - DNA, 20 bp, Artificial Sequence
  Description of Artificial Sequence: Synthetic oligonucleotide
atttgtcttttgtgttaccg

SEQ ID NO: 5038 - DNA, 20 bp, Artificial Sequence
  Description of Artificial Sequence: Synthetic oligonucleotide
tcttcttttcttctgctccg

SEQ ID NO: 5039 - DNA, 20 bp, Artificial Sequence
  Description of Artificial Sequence: Synthetic oligonucleotide
atttgttcatgtttcctccg

SEQ ID NO: 5040 - DNA, 20 bp, Artificial Sequence
  Description of Artificial Sequence: Synthetic oligonucleotide
cactactttattcctctccg

SEQ ID NO: 5041 - DNA, 20 bp, Artificial Sequence
  Description of Artificial Sequence: Synthetic oligonucleotide
gttttcaatcgctctttccg

SEQ ID NO: 5042 - DNA, 20 bp, Artificial Sequence
  Description of Artificial Sequence: Synthetic oligonucleotide
tactttctcattttctgctg

SEQ ID NO: 5043 - DNA, 20 bp, Artificial Sequence
  Description of Artificial Sequence: Synthetic oligonucleotide
atttattatcgctgtttccg

SEQ ID NO: 5044 - DNA, 20 bp, Artificial Sequence
  Description of Artificial Sequence: Synthetic oligonucleotide
ctttttacgccctttttccg

SEQ ID NO: 5045 - DNA, 22 bp, Artificial Sequence
  Description of Artificial Sequence: Synthetic oligonucleotide
tttcctagagttttttgttccg

SEQ ID NO: 5046 - DNA, 20 bp, Artificial Sequence
  Description of Artificial Sequence: Synthetic oligonucleotide
gtttttattctctcattccc

SEQ ID NO: 5047 - DNA, 20 bp, Artificial Sequence
  Description of Artificial Sequence: Synthetic oligonucleotide
tttcatacttcctacttccg

SEQ ID NO: 5048 - DNA, 22 bp, Artificial Sequence
  Description of Artificial Sequence: Synthetic oligonucleotide
cttttcctttttttttgttccg

SEQ ID NO: 5049 - DNA, 20 bp, Artificial Sequence
  Description of Artificial Sequence: Synthetic oligonucleotide
actttgctcttgttttaccc

SEQ ID NO: 5050 - DNA, 20 bp, Artificial Sequence
  Description of Artificial Sequence: Synthetic oligonucleotide
tctttatttattgctatccg

SEQ ID NO: 5051 - DNA, 20 bp, Artificial Sequence
  Description of Artificial Sequence: Synthetic oligonucleotide
ctttcgctttttatcttccg

SEQ ID NO: 5052 - DNA, 20 bp, Artificial Sequence
  Description of Artificial Sequence: Synthetic oligonucleotide
ttttcacattcttttctcgc

SEQ ID NO: 5053 - DNA, 20 bp, Artificial Sequence
  Description of Artificial Sequence: Synthetic oligonucleotide
atcttaatctcttttctccg

SEQ ID NO: 5054 - DNA, 20 bp, Artificial Sequence
  Description of Artificial Sequence: Synthetic oligonucleotide
tctttaattattcccctccg

SEQ ID NO: 5055 - DNA, 20 bp, Artificial Sequence
  Description of Artificial Sequence: Synthetic oligonucleotide
aattccttttatctttgccc

SEQ ID NO: 5056 - DNA, 20 bp, Artificial Sequence
  Description of Artificial Sequence: Synthetic oligonucleotide
gtttcttattatctttcccc

SEQ ID NO: 5057 - DNA, 20 bp, Artificial Sequence
  Description of Artificial Sequence: Synthetic oligonucleotide
tatctctggccttttttccg

SEQ ID NO: 5058 - DNA, 20 bp, Artificial Sequence
  Description of Artificial Sequence: Synthetic oligonucleotide
ttatttttgtttgtttgccc

SEQ ID NO: 5059 - DNA, 20 bp, Artificial Sequence
  Description of Artificial Sequence: Synthetic oligonucleotide
actttttatctttccaaccg

SEQ ID NO: 5060 - DNA, 20 bp, Artificial Sequence
  Description of Artificial Sequence: Synthetic oligonucleotide
attctttacactattcaccg

SEQ ID NO: 5061 - DNA, 20 bp, Artificial Sequence
  Description of Artificial Sequence: Synthetic oligonucleotide
ctttttcaatccttcttccg

SEQ ID NO: 5062 - DNA, 20 bp, Artificial Sequence
  Description of Artificial Sequence: Synthetic oligonucleotide
acttttttcactttcttccg

SEQ ID NO: 5063 - DNA, 20 bp, Artificial Sequence
  Description of Artificial Sequence: Synthetic oligonucleotide
gattgtttattttttacccc

SEQ ID NO: 5064 - DNA, 20 bp, Artificial Sequence
  Description of Artificial Sequence: Synthetic oligonucleotide
cttctgttttcattcttccg

SEQ ID NO: 5065 - DNA, 20 bp, Artificial Sequence
  Description of Artificial Sequence: Synthetic oligonucleotide
tttcatttttttattctccg

SEQ ID NO: 5066 - DNA, 20 bp, Artificial Sequence
  Description of Artificial Sequence: Synthetic oligonucleotide
tcattctttttattcctctg

SEQ ID NO: 5067 - DNA, 21 bp, Artificial Sequence
  Description of Artificial Sequence: Synthetic oligonucleotide
tttctgacacttttttttccg

SEQ ID NO: 5068 - DNA, 20 bp, Artificial Sequence
  Description of Artificial Sequence: Synthetic oligonucleotide
actttctatatttcattccg

SEQ ID NO: 5069 - DNA, 20 bp, Artificial Sequence
  Description of Artificial Sequence: Synthetic oligonucleotide
atttatttatgctttttccc

SEQ ID NO: 5070 - DNA, 19 bp, Artificial Sequence
  Description of Artificial Sequence: Synthetic oligonucleotide
tttgttttttttgtttctg

SEQ ID NO: 5071 - DNA, 20 bp, Artificial Sequence
  Description of Artificial Sequence: Synthetic oligonucleotide
tattctctttttcctttctg

SEQ ID NO: 5072 - DNA, 20 bp, Artificial Sequence
  Description of Artificial Sequence: Synthetic oligonucleotide
atattttccatcttttgctg

SEQ ID NO: 5073 - DNA, 20 bp, Artificial Sequence
  Description of Artificial Sequence: Synthetic oligonucleotide
tcttttattttatttccccc

SEQ ID NO: 5074 - DNA, 20 bp, Artificial Sequence
  Description of Artificial Sequence: Synthetic oligonucleotide
cttttattctattttttccg

SEQ ID NO: 5075 - DNA, 21 bp, Artificial Sequence
  Description of Artificial Sequence: Synthetic oligonucleotide
tttttatttttcttttcgcca

SEQ ID NO: 5076 - DNA, 20 bp, Artificial Sequence
  Description of Artificial Sequence: Synthetic oligonucleotide
ctttattttttcctcttgcc

SEQ ID NO: 5077 - DNA, 20 bp, Artificial Sequence
  Description of Artificial Sequence: Synthetic oligonucleotide
cttctttatttctctctcgc

SEQ ID NO: 5078 - DNA, 21 bp, Artificial Sequence
  Description of Artificial Sequence: Synthetic oligonucleotide
attgttttattgtttttaccg

SEQ ID NO: 5079 - DNA, 21 bp, Artificial Sequence
  Description of Artificial Sequence: Synthetic oligonucleotide
atattattttgtttttttgcc

SEQ ID NO: 5080 - DNA, 20 bp, Artificial Sequence
  Description of Artificial Sequence: Synthetic oligonucleotide
atttactttttattactgtg

SEQ ID NO: 5081 - DNA, 19 bp, Artificial Sequence
  Description of Artificial Sequence: Synthetic oligonucleotide
ttttccttatacttttccg

SEQ ID NO: 5082 - DNA, 21 bp, Artificial Sequence
  Description of Artificial Sequence: Synthetic oligonucleotide
ccatttcttcatttttttccg

SEQ ID NO: 5083 - DNA, 20 bp, Artificial Sequence
  Description of Artificial Sequence: Synthetic oligonucleotide
tcctgtcggctgtgcgtccc

SEQ ID NO: 5084 - DNA, 20 bp, Artificial Sequence
  Description of Artificial Sequence: Synthetic oligonucleotide
tcctttcgttctgccttccc

SEQ ID NO: 5085 - DNA, 20 bp, Artificial Sequence
  Description of Artificial Sequence: Synthetic oligonucleotide
ttctcatttcttcacctccg

SEQ ID NO: 5086 - DNA, 20 bp, Artificial Sequence
  Description of Artificial Sequence: Synthetic oligonucleotide
aatgttcttctctttgtccg

SEQ ID NO: 5087 - DNA, 20 bp, Artificial Sequence
  Description of Artificial Sequence: Synthetic oligonucleotide
tttgggagtaggatgttccg

SEQ ID NO: 5088 - DNA, 20 bp, Artificial Sequence
  Description of Artificial Sequence: Synthetic oligonucleotide
cctttcttttctttcccgcc

SEQ ID NO: 5089 - DNA, 20 bp, Artificial Sequence
  Description of Artificial Sequence: Synthetic oligonucleotide
tctttgtaaccttctttccg

SEQ ID NO: 5090 - DNA, 20 bp, Artificial Sequence
  Description of Artificial Sequence: Synthetic oligonucleotide
gatcattttactcttctccc

SEQ ID NO: 5091 - DNA, 20 bp, Artificial Sequence
  Description of Artificial Sequence: Synthetic oligonucleotide
actctttcgtattctttccg

SEQ ID NO: 5092 - DNA, 20 bp, Artificial Sequence
  Description of Artificial Sequence: Synthetic oligonucleotide
ctcttttatgtccctttccg

SEQ ID NO: 5093 - DNA, 20 bp, Artificial Sequence
  Description of Artificial Sequence: Synthetic oligonucleotide
tcttttgctgttttcatccg

SEQ ID NO: 5094 - DNA, 21 bp, Artificial Sequence
  Description of Artificial Sequence: Synthetic oligonucleotide
tactcatcttacttctttccg

SEQ ID NO: 5095 - DNA, 20 bp, Artificial Sequence
  Description of Artificial Sequence: Synthetic oligonucleotide
tttcctatcttgttcttccg

SEQ ID NO: 5096 - DNA, 20 bp, Artificial Sequence
  Description of Artificial Sequence: Synthetic oligonucleotide
tatttttcctttcttgtgcc

SEQ ID NO: 5097 - DNA, 20 bp, Artificial Sequence
  Description of Artificial Sequence: Synthetic oligonucleotide
tctgtttttattgtttgccg

SEQ ID NO: 5098 - DNA, 20 bp, Artificial Sequence
  Description of Artificial Sequence: Synthetic oligonucleotide
tttttctttcaccttttccc

SEQ ID NO: 5099 - DNA, 20 bp, Artificial Sequence
  Description of Artificial Sequence: Synthetic oligonucleotide
ttccttacttttcccttccg

SEQ ID NO: 5100 - DNA, 20 bp, Artificial Sequence
  Description of Artificial Sequence: Synthetic oligonucleotide
gcttttttcttttcccgccg

SEQ ID NO: 5101 - DNA, 20 bp, Artificial Sequence
  Description of Artificial Sequence: Synthetic oligonucleotide
tcttgtttggtctttctccg

SEQ ID NO: 5102 - DNA, 20 bp, Artificial Sequence
  Description of Artificial Sequence: Synthetic oligonucleotide
tattttcttattttcgactg

SEQ ID NO: 5103 - DNA, 20 bp, Artificial Sequence
  Description of Artificial Sequence: Synthetic oligonucleotide
ttatttctttgttttcgccc

SEQ ID NO: 5104 - DNA, 20 bp, Artificial Sequence
  Description of Artificial Sequence: Synthetic oligonucleotide
attctctttctttttctccg

SEQ ID NO: 5105 - DNA, 22 bp, Artificial Sequence
  Description of Artificial Sequence: Synthetic oligonucleotide
ttttcgttttttttttgcgccg

SEQ ID NO: 5106 - DNA, 20 bp, Artificial Sequence
  Description of Artificial Sequence: Synthetic oligonucleotide
ccttcattcattctcttccg

SEQ ID NO: 5107 - DNA, 21 bp, Artificial Sequence
  Description of Artificial Sequence: Synthetic oligonucleotide
atagttttgtttttttcgccg

SEQ ID NO: 5108 - DNA, 20 bp, Artificial Sequence
  Description of Artificial Sequence: Synthetic oligonucleotide
acttctcatctttttctccg

SEQ ID NO: 5109 - DNA, 20 bp, Artificial Sequence
  Description of Artificial Sequence: Synthetic oligonucleotide
tgtttttactcttgcttccg

SEQ ID NO: 5110 - DNA, 20 bp, Artificial Sequence
  Description of Artificial Sequence: Synthetic oligonucleotide
tttttgttagctttcccccg

SEQ ID NO: 5111 - DNA, 20 bp, Artificial Sequence
  Description of Artificial Sequence: Synthetic oligonucleotide
tgctttggtttttttttccg

SEQ ID NO: 5112 - DNA, 20 bp, Artificial Sequence
  Description of Artificial Sequence: Synthetic oligonucleotide
ttttctttatctattcgccg

SEQ ID NO: 5113 - DNA, 20 bp, Artificial Sequence
  Description of Artificial Sequence: Synthetic oligonucleotide
atcttatttctattttgccg

SEQ ID NO: 5114 - DNA, 20 bp, Artificial Sequence
  Description of Artificial Sequence: Synthetic oligonucleotide
cttctcgtttttttctaccg

SEQ ID NO: 5115 - DNA, 20 bp, Artificial Sequence
  Description of Artificial Sequence: Synthetic oligonucleotide
cctttaacgattcttttccg

SEQ ID NO: 5116 - DNA, 20 bp, Artificial Sequence
  Description of Artificial Sequence: Synthetic oligonucleotide
ttctttttgttttcatgccg

SEQ ID NO: 5117 - DNA, 20 bp, Artificial Sequence
  Description of Artificial Sequence: Synthetic oligonucleotide
attttcttcttctcttaccg

SEQ ID NO: 5118 - DNA, 20 bp, Artificial Sequence
  Description of Artificial Sequence: Synthetic oligonucleotide
ctttcatgcttcctttaccg

SEQ ID NO: 5119 - DNA, 20 bp, Artificial Sequence
  Description of Artificial Sequence: Synthetic oligonucleotide
tttatcctatttctcgtccg

SEQ ID NO: 5120 - DNA, 20 bp, Artificial Sequence
  Description of Artificial Sequence: Synthetic oligonucleotide
ctttattacgtttctttccg

SEQ ID NO: 5121 - DNA, 21 bp, Artificial Sequence
  Description of Artificial Sequence: Synthetic oligonucleotide
ttgttattcttttttttgccc

SEQ ID NO: 5122 - DNA, 20 bp, Artificial Sequence
  Description of Artificial Sequence: Synthetic oligonucleotide
acctttttaatttttctccg

SEQ ID NO: 5123 - DNA, 20 bp, Artificial Sequence
  Description of Artificial Sequence: Synthetic oligonucleotide
tttgtctcttattttacccg

SEQ ID NO: 5124 - DNA, 20 bp, Artificial Sequence
  Description of Artificial Sequence: Synthetic oligonucleotide
tttttattttcttgttcctg

SEQ ID NO: 5125 - DNA, 20 bp, Artificial Sequence
  Description of Artificial Sequence: Synthetic oligonucleotide
gttttttaatttttgttccc

SEQ ID NO: 5126 - DNA, 20 bp, Artificial Sequence
  Description of Artificial Sequence: Synthetic oligonucleotide
tcatttggtttttttatccg

SEQ ID NO: 5127 - DNA, 22 bp, Artificial Sequence
  Description of Artificial Sequence: Synthetic oligonucleotide
ttccactttttttttttctccg

SEQ ID NO: 5128 - DNA, 20 bp, Artificial Sequence
  Description of Artificial Sequence: Synthetic oligonucleotide
ttacttttctttttctaccc

SEQ ID NO: 5129 - DNA, 20 bp, Artificial Sequence
  Description of Artificial Sequence: Synthetic oligonucleotide
ctttttatctatctttaccg

SEQ ID NO: 5130 - DNA, 21 bp, Artificial Sequence
  Description of Artificial Sequence: Synthetic oligonucleotide
aacacttttttattcttactg

SEQ ID NO: 5131 - DNA, 20 bp, Artificial Sequence
  Description of Artificial Sequence: Synthetic oligonucleotide
tcgctttatttacttttccc

SEQ ID NO: 5132 - DNA, 20 bp, Artificial Sequence
  Description of Artificial Sequence: Synthetic oligonucleotide
tcttttactaatttaccccg

SEQ ID NO: 5133 - DNA, 21 bp, Artificial Sequence
  Description of Artificial Sequence: Synthetic oligonucleotide
tgttttatttgtttttttccc

SEQ ID NO: 5134 - DNA, 18 bp, Artificial Sequence
  Description of Artificial Sequence: Synthetic oligonucleotide
tttgtttttctctttccg

SEQ ID NO: 5135 - DNA, 22 bp, Artificial Sequence
  Description of Artificial Sequence: Synthetic oligonucleotide
tttgttttattttttttgtccc

SEQ ID NO: 5136 - DNA, 19 bp, Artificial Sequence
  Description of Artificial Sequence: Synthetic oligonucleotide
tatttacgttttttttgtg

SEQ ID NO: 5137 - DNA, 18 bp, Artificial Sequence
  Description of Artificial Sequence: Synthetic oligonucleotide
tttcttctttcttttccg

SEQ ID NO: 5138 - DNA, 21 bp, Artificial Sequence
  Description of Artificial Sequence: Synthetic oligonucleotide
ttttatctctgtttttttgcc

SEQ ID NO: 5139 - DNA, 21 bp, Artificial Sequence
  Description of Artificial Sequence: Synthetic oligonucleotide
tcctgtcgtctgttcgtgccc

SEQ ID NO: 5140 - DNA, 18 bp, Artificial Sequence
  Description of Artificial Sequence: Synthetic oligonucleotide
atcttttctttcttgccg

SEQ ID NO: 5141 - DNA, 21 bp, Artificial Sequence
  Description of Artificial Sequence: Synthetic oligonucleotide
attcggtctttttttgctccg

SEQ ID NO: 5142 - DNA, 20 bp, Artificial Sequence
  Description of Artificial Sequence: Synthetic oligonucleotide
tttttagttttcttgttccg

SEQ ID NO: 5143 - DNA, 20 bp, Artificial Sequence
  Description of Artificial Sequence: Synthetic oligonucleotide
attcactttattccccaccg

SEQ ID NO: 5144 - DNA, 19 bp, Artificial Sequence
  Description of Artificial Sequence: Synthetic oligonucleotide
cttttccttttttgttccg

SEQ ID NO: 5145 - DNA, 20 bp, Artificial Sequence
  Description of Artificial Sequence: Synthetic oligonucleotide
gttttgttcttgtgtttccg

SEQ ID NO: 5146 - DNA, 20 bp, Artificial Sequence
  Description of Artificial Sequence: Synthetic oligonucleotide
atcttttctttcctttgccg

SEQ ID NO: 5147 - DNA, 20 bp, Artificial Sequence
  Description of Artificial Sequence: Synthetic oligonucleotide
tcacatttttctctcgtccc

SEQ ID NO: 5148 - DNA, 20 bp, Artificial Sequence
  Description of Artificial Sequence: Synthetic oligonucleotide
tacttactttatcttctccg

SEQ ID NO: 5149 - DNA, 20 bp, Artificial Sequence
  Description of Artificial Sequence: Synthetic oligonucleotide
aatccttttccttctatccg

SEQ ID NO: 5150 - DNA, 19 bp, Artificial Sequence
  Description of Artificial Sequence: Synthetic oligonucleotide
ttttttgattcttgttccg

SEQ ID NO: 5151 - DNA, 20 bp, Artificial Sequence
  Description of Artificial Sequence: Synthetic oligonucleotide
tcttatcacgttcttttccg

SEQ ID NO: 5152 - DNA, 20 bp, Artificial Sequence
  Description of Artificial Sequence: Synthetic oligonucleotide
ctttcacaactctctctccg

SEQ ID NO: 5153 - DNA, 21 bp, Artificial Sequence
  Description of Artificial Sequence: Synthetic oligonucleotide
tctttttttcatttctcaccg

SEQ ID NO: 5154 - DNA, 20 bp, Artificial Sequence
  Description of Artificial Sequence: Synthetic oligonucleotide
tgctcttgttttcctttccg

SEQ ID NO: 5155 - DNA, 20 bp, Artificial Sequence
  Description of Artificial Sequence: Synthetic oligonucleotide
gttctactatttcttcaccg

SEQ ID NO: 5156 - DNA, 20 bp, Artificial Sequence
  Description of Artificial Sequence: Synthetic oligonucleotide
actctctttcttttctgccg

SEQ ID NO: 5157 - DNA, 20 bp, Artificial Sequence
  Description of Artificial Sequence: Synthetic oligonucleotide
cctttttaactacctttccg

SEQ ID NO: 5158 - DNA, 20 bp, Artificial Sequence
  Description of Artificial Sequence: Synthetic oligonucleotide
tccatgctttttttttgccg

SEQ ID NO: 5159 - DNA, 20 bp, Artificial Sequence
  Description of Artificial Sequence: Synthetic oligonucleotide
cctttctttttccctatccg

SEQ ID NO: 5160 - DNA, 20 bp, Artificial Sequence
  Description of Artificial Sequence: Synthetic oligonucleotide
gttcatgtttctttccaccg

SEQ ID NO: 5161 - DNA, 20 bp, Artificial Sequence
  Description of Artificial Sequence: Synthetic oligonucleotide
atttccctctttcattaccg

SEQ ID NO: 5162 - DNA, 19 bp, Artificial Sequence
  Description of Artificial Sequence: Synthetic oligonucleotide
atttctcttcttcttgccg

SEQ ID NO: 5163 - DNA, 20 bp, Artificial Sequence
  Description of Artificial Sequence: Synthetic oligonucleotide
aatttctctcgctctatccg

SEQ ID NO: 5164 - DNA, 20 bp, Artificial Sequence
  Description of Artificial Sequence: Synthetic oligonucleotide
tctttttgttctttcttgcc

SEQ ID NO: 5165 - DNA, 20 bp, Artificial Sequence
  Description of Artificial Sequence: Synthetic oligonucleotide
ttttttccttaatttgtccg

SEQ ID NO: 5166 - DNA, 20 bp, Artificial Sequence
  Description of Artificial Sequence: Synthetic oligonucleotide
atttttaagttgtttttgcc

SEQ ID NO: 5167 - DNA, 20 bp, Artificial Sequence
  Description of Artificial Sequence: Synthetic oligonucleotide
ttctttttgtcattcttctg

SEQ ID NO: 5168 - DNA, 20 bp, Artificial Sequence
  Description of Artificial Sequence: Synthetic oligonucleotide
atactttacctttttttgcc

SEQ ID NO: 5169 - DNA, 20 bp, Artificial Sequence
  Description of Artificial Sequence: Synthetic oligonucleotide
ccatttcttttcttactccg

SEQ ID NO: 5170 - DNA, 20 bp, Artificial Sequence
  Description of Artificial Sequence: Synthetic oligonucleotide
ttctctattatctttgtccg

SEQ ID NO: 5171 - DNA, 21 bp, Artificial Sequence
  Description of Artificial Sequence: Synthetic oligonucleotide
actttattctctttttttccg

SEQ ID NO: 5172 - DNA, 21 bp, Artificial Sequence
  Description of Artificial Sequence: Synthetic oligonucleotide
atttttttgttgttttgaccg

SEQ ID NO: 5173 - DNA, 20 bp, Artificial Sequence
  Description of Artificial Sequence: Synthetic oligonucleotide
ttttcttttgtttttttgtg

SEQ ID NO: 5174 - DNA, 20 bp, Artificial Sequence
  Description of Artificial Sequence: Synthetic oligonucleotide
ttattcttttgtttttacgc

SEQ ID NO: 5175 - DNA, 20 bp, Artificial Sequence
  Description of Artificial Sequence: Synthetic oligonucleotide
ttacttggttattttttctg

SEQ ID NO: 5176 - DNA, 20 bp, Artificial Sequence
  Description of Artificial Sequence: Synthetic oligonucleotide
tttttgctttatctgtcccg

SEQ ID NO: 5177 - DNA, 20 bp, Artificial Sequence
  Description of Artificial Sequence: Synthetic oligonucleotide
ttcattttctattctttgcc

SEQ ID NO: 5178 - DNA, 20 bp, Artificial Sequence
  Description of Artificial Sequence: Synthetic oligonucleotide
ttctttttcttctattcccg

SEQ ID NO: 5179 - DNA, 20 bp, Artificial Sequence
  Description of Artificial Sequence: Synthetic oligonucleotide
ctttctcttattcttccccg

SEQ ID NO: 5180 - DNA, 20 bp, Artificial Sequence
  Description of Artificial Sequence: Synthetic oligonucleotide
tttttactgctttttatccg

SEQ ID NO: 5181 - DNA, 20 bp, Artificial Sequence
  Description of Artificial Sequence: Synthetic oligonucleotide
tcactttcatatttcttccg

SEQ ID NO: 5182 - DNA, 19 bp, Artificial Sequence
  Description of Artificial Sequence: Synthetic oligonucleotide
tttttttttcttgtttccg

SEQ ID NO: 5183 - DNA, 20 bp, Artificial Sequence
  Description of Artificial Sequence: Synthetic oligonucleotide
tctttcagctctttttcccg

SEQ ID NO: 5184 - DNA, 22 bp, Artificial Sequence
  Description of Artificial Sequence: Synthetic oligonucleotide
ccttgtttgtttttttttcccg

SEQ ID NO: 5185 - DNA, 20 bp, Artificial Sequence
  Description of Artificial Sequence: Synthetic oligonucleotide
tttctgctatttttcttccg

SEQ ID NO: 5186 - DNA, 20 bp, Artificial Sequence
  Description of Artificial Sequence: Synthetic oligonucleotide
aatttattatttctccgccg

SEQ ID NO: 5187 - DNA, 20 bp, Artificial Sequence
  Description of Artificial Sequence: Synthetic oligonucleotide
ttgttatttatttgtttgcc

SEQ ID NO: 5188 - DNA, 20 bp, Artificial Sequence
  Description of Artificial Sequence: Synthetic oligonucleotide
cttttttaattacccttccg

SEQ ID NO: 5189 - DNA, 20 bp, Artificial Sequence
  Description of Artificial Sequence: Synthetic oligonucleotide
cttatttatcttgttttctg

SEQ ID NO: 5190 - DNA, 20 bp, Artificial Sequence
  Description of Artificial Sequence: Synthetic oligonucleotide
cactttcattttcttttcgc

SEQ ID NO: 5191 - DNA, 20 bp, Artificial Sequence
  Description of Artificial Sequence: Synthetic oligonucleotide
cccttatttattcgcttccg

SEQ ID NO: 5192 - DNA, 21 bp, Artificial Sequence
  Description of Artificial Sequence: Synthetic oligonucleotide
tctttatttttttcctttccg

SEQ ID NO: 5193 - DNA, 20 bp, Artificial Sequence
  Description of Artificial Sequence: Synthetic oligonucleotide
tatttcacatctcttttccg

SEQ ID NO: 5194 - DNA, 20 bp, Artificial Sequence
  Description of Artificial Sequence: Synthetic oligonucleotide
tcttttactttcttatcctg

SEQ ID NO: 5195 - DNA, 20 bp, Artificial Sequence
  Description of Artificial Sequence: Synthetic oligonucleotide
tttattttacgtttgttctg

SEQ ID NO: 5196 - DNA, 20 bp, Artificial Sequence
  Description of Artificial Sequence: Synthetic oligonucleotide
ctttttttcctttttttccg

SEQ ID NO: 5197 - DNA, 20 bp, Artificial Sequence
  Description of Artificial Sequence: Synthetic oligonucleotide
tccgtttctttctttccccg

SEQ ID NO: 5198 - DNA, 20 bp, Artificial Sequence
  Description of Artificial Sequence: Synthetic oligonucleotide
ttttttaccaaccttttccg

SEQ ID NO: 5199 - DNA, 21 bp, Artificial Sequence
  Description of Artificial Sequence: Synthetic oligonucleotide
tttattttttttttcgctccg

SEQ ID NO: 5200 - DNA, 21 bp, Artificial Sequence
  Description of Artificial Sequence: Synthetic oligonucleotide
tttcattttttttattctccg

SEQ ID NO: 5201 - DNA, 21 bp, Artificial Sequence
  Description of Artificial Sequence: Synthetic oligonucleotide
tactttaatcttttttttccg

SEQ ID NO: 5202 - DNA, 20 bp, Artificial Sequence
  Description of Artificial Sequence: Synthetic oligonucleotide
acattttctctttttctgcg

SEQ ID NO: 5203 - DNA, 22 bp, Artificial Sequence
  Description of Artificial Sequence: Synthetic oligonucleotide
tatttatttttttcttgccccg

SEQ ID NO: 5204 - DNA, 21 bp, Artificial Sequence
  Description of Artificial Sequence: Synthetic oligonucleotide
attttttgtcttttgttactg

SEQ ID NO: 5205 - DNA, 19 bp, Artificial Sequence
  Description of Artificial Sequence: Synthetic oligonucleotide
tttttcatacctttttccg

SEQ ID NO: 5206 - DNA, 20 bp, Artificial Sequence
  Description of Artificial Sequence: Synthetic oligonucleotide
tttgttgttgtttttttctg

SEQ ID NO: 5207 - DNA, 21 bp, Artificial Sequence
  Description of Artificial Sequence: Synthetic oligonucleotide
cttttcatttctttttttccg

SEQ ID NO: 5208 - DNA, 18 bp, Artificial Sequence
  Description of Artificial Sequence: Synthetic oligonucleotide
tcttgttttttttggccc

SEQ ID NO: 5209 - DNA, 21 bp, Artificial Sequence
  Description of Artificial Sequence: Synthetic oligonucleotide
tgtgtcttttcttttctgccc

SEQ ID NO: 5210 - DNA, 20 bp, Artificial Sequence
  Description of Artificial Sequence: Synthetic oligonucleotide
tcccttcgttctgccctccc

SEQ ID NO: 5211 - DNA, 20 bp, Artificial Sequence
  Description of Artificial Sequence: Synthetic oligonucleotide
tcttattttcttttgtcccc

SEQ ID NO: 5212 - DNA, 21 bp, Artificial Sequence
  Description of Artificial Sequence: Synthetic oligonucleotide
caccttttcttttccgctccg

SEQ ID NO: 5213 - DNA, 20 bp, Artificial Sequence
  Description of Artificial Sequence: Synthetic oligonucleotide
attccttttcttctttgccg

SEQ ID NO: 5214 - DNA, 20 bp, Artificial Sequence
  Description of Artificial Sequence: Synthetic oligonucleotide
ttcttcgtattctcttgccg

SEQ ID NO: 5215 - DNA, 20 bp, Artificial Sequence
  Description of Artificial Sequence: Synthetic oligonucleotide
ttttcgttttttttgcgccg

SEQ ID NO: 5216 - DNA, 20 bp, Artificial Sequence
  Description of Artificial Sequence: Synthetic oligonucleotide
tatctgtctctttttcgccg

SEQ ID NO: 5217 - DNA, 21 bp, Artificial Sequence
  Description of Artificial Sequence: Synthetic oligonucleotide
cctgtttatttttttgccccc

SEQ ID NO: 5218 - DNA, 21 bp, Artificial Sequence
  Description of Artificial Sequence: Synthetic oligonucleotide
agatttgtttttttgtggccg

SEQ ID NO: 5219 - DNA, 20 bp, Artificial Sequence
  Description of Artificial Sequence: Synthetic oligonucleotide
ttcttttggcttattctccg

SEQ ID NO: 5220 - DNA, 19 bp, Artificial Sequence
  Description of Artificial Sequence: Synthetic oligonucleotide
atcttttcttcttctgccg

SEQ ID NO: 5221 - DNA, 20 bp, Artificial Sequence
  Description of Artificial Sequence: Synthetic oligonucleotide
gttgcttttttctattcccc

SEQ ID NO: 5222 - DNA, 20 bp, Artificial Sequence
  Description of Artificial Sequence: Synthetic oligonucleotide
ttttactcatttttcccgtg

SEQ ID NO: 5223 - DNA, 21 bp, Artificial Sequence
  Description of Artificial Sequence: Synthetic oligonucleotide
tgttttgttttttttgtcccc

SEQ ID NO: 5224 - DNA, 20 bp, Artificial Sequence
  Description of Artificial Sequence: Synthetic oligonucleotide
atgctctctttttcttgccg

SEQ ID NO: 5225 - DNA, 20 bp, Artificial Sequence
  Description of Artificial Sequence: Synthetic oligonucleotide
ttttctttgtcttcttgccg

SEQ ID NO: 5226 - DNA, 20 bp, Artificial Sequence
  Description of Artificial Sequence: Synthetic oligonucleotide
accttattttatcttctccg

SEQ ID NO: 5227 - DNA, 20 bp, Artificial Sequence
  Description of Artificial Sequence: Synthetic oligonucleotide
attatctaattctttcaccg

SEQ ID NO: 5228 - DNA, 20 bp, Artificial Sequence
  Description of Artificial Sequence: Synthetic oligonucleotide
ctttgcttattttttctccg

SEQ ID NO: 5229 - DNA, 20 bp, Artificial Sequence
  Description of Artificial Sequence: Synthetic oligonucleotide
ttattatcctttttctcccg

SEQ ID NO: 5230 - DNA, 20 bp, Artificial Sequence
  Description of Artificial Sequence: Synthetic oligonucleotide
aattttcccctcttttaccg

SEQ ID NO: 5231 - DNA, 20 bp, Artificial Sequence
  Description of Artificial Sequence: Synthetic oligonucleotide
tcttcatggttatttttccg

SEQ ID NO: 5232 - DNA, 19 bp, Artificial Sequence
  Description of Artificial Sequence: Synthetic oligonucleotide
tcttttctctatctatccg

SEQ ID NO: 5233 - DNA, 20 bp, Artificial Sequence
  Description of Artificial Sequence: Synthetic oligonucleotide
atgtttctcttctctttccg

SEQ ID NO: 5234 - DNA, 20 bp, Artificial Sequence
  Description of Artificial Sequence: Synthetic oligonucleotide
ctattcctattccctttccg

SEQ ID NO: 5235 - DNA, 20 bp, Artificial Sequence
  Description of Artificial Sequence: Synthetic oligonucleotide
ttttcttatttctctacccg

SEQ ID NO: 5236 - DNA, 19 bp, Artificial Sequence
  Description of Artificial Sequence: Synthetic oligonucleotide
attggaggaggaggttccg

SEQ ID NO: 5237 - DNA, 20 bp, Artificial Sequence
  Description of Artificial Sequence: Synthetic oligonucleotide
tctttcactagctttttccg

SEQ ID NO: 5238 - DNA, 19 bp, Artificial Sequence
  Description of Artificial Sequence: Synthetic oligonucleotide
atttcttcttcttttaccg

SEQ ID NO: 5239 - DNA, 19 bp, Artificial Sequence
  Description of Artificial Sequence: Synthetic oligonucleotide
ctttttcttctttctccgc

SEQ ID NO: 5240 - DNA, 20 bp, Artificial Sequence
  Description of Artificial Sequence: Synthetic oligonucleotide
tttcttttgtattttatccc

SEQ ID NO: 5241 - DNA, 20 bp, Artificial Sequence
  Description of Artificial Sequence: Synthetic oligonucleotide
tttctttgttttcctgccgc

SEQ ID NO: 5242 - DNA, 18 bp, Artificial Sequence
  Description of Artificial Sequence: Synthetic oligonucleotide
gccttcgttctgcctccc

SEQ ID NO: 5243 - DNA, 20 bp, Artificial Sequence
  Description of Artificial Sequence: Synthetic oligonucleotide
ttctttttattctacatccg

SEQ ID NO: 5244 - DNA, 20 bp, Artificial Sequence
  Description of Artificial Sequence: Synthetic oligonucleotide
ttttctggtttttacttccg

SEQ ID NO: 5245 - DNA, 20 bp, Artificial Sequence
  Description of Artificial Sequence: Synthetic oligonucleotide
attttctcatttctctaccc

SEQ ID NO: 5246 - DNA, 20 bp, Artificial Sequence
  Description of Artificial Sequence: Synthetic oligonucleotide
ttttctctatgttttatccc

SEQ ID NO: 5247 - DNA, 20 bp, Artificial Sequence
  Description of Artificial Sequence: Synthetic oligonucleotide
tattctttctttcttttcgc

SEQ ID NO: 5248 - DNA, 20 bp, Artificial Sequence
  Description of Artificial Sequence: Synthetic oligonucleotide
cctgtttttctcgttttccg

SEQ ID NO: 5249 - DNA, 20 bp, Artificial Sequence
  Description of Artificial Sequence: Synthetic oligonucleotide
tttggctctcttattttccg

SEQ ID NO: 5250 - DNA, 20 bp, Artificial Sequence
  Description of Artificial Sequence: Synthetic oligonucleotide
gtttactttaactttttccc

SEQ ID NO: 5251 - DNA, 21 bp, Artificial Sequence
  Description of Artificial Sequence: Synthetic oligonucleotide
ttttttaatgttttttttccg

SEQ ID NO: 5252 - DNA, 20 bp, Artificial Sequence
  Description of Artificial Sequence: Synthetic oligonucleotide
gtatttatttcttgttgctg

SEQ ID NO: 5253 - DNA, 21 bp, Artificial Sequence
  Description of Artificial Sequence: Synthetic oligonucleotide
ttttctatctttttttgtccg

SEQ ID NO: 5254 - DNA, 21 bp, Artificial Sequence
  Description of Artificial Sequence: Synthetic oligonucleotide
ttttttcttttcctttgtccg

SEQ ID NO: 5255 - DNA, 21 bp, Artificial Sequence
  Description of Artificial Sequence: Synthetic oligonucleotide
tttgtttttctcttttttccg

SEQ ID NO: 5256 - DNA, 22 bp, Artificial Sequence
  Description of Artificial Sequence: Synthetic oligonucleotide
ttttagcttctttttttgtcct

SEQ ID NO: 5257 - DNA, 20 bp, Artificial Sequence
  Description of Artificial Sequence: Synthetic oligonucleotide
attcctattttcttctcccg

SEQ ID NO: 5258 - DNA, 20 bp, Artificial Sequence
  Description of Artificial Sequence: Synthetic oligonucleotide
cttttctcgtactatttccg

SEQ ID NO: 5259 - DNA, 21 bp, Artificial Sequence
  Description of Artificial Sequence: Synthetic oligonucleotide
ttttacattcattttttgcgc

SEQ ID NO: 5260 - DNA, 20 bp, Artificial Sequence
  Description of Artificial Sequence: Synthetic oligonucleotide
ttttatttattctctctccg

SEQ ID NO: 5261 - DNA, 20 bp, Artificial Sequence
  Description of Artificial Sequence: Synthetic oligonucleotide
ctttatatctattttctccg

SEQ ID NO: 5262 - DNA, 20 bp, Artificial Sequence
  Description of Artificial Sequence: Synthetic oligonucleotide
ttttttcttgttgcttgctg

SEQ ID NO: 5263 - DNA, 20 bp, Artificial Sequence
  Description of Artificial Sequence: Synthetic oligonucleotide
gttcttattttcttcccctg

SEQ ID NO: 5264 - DNA, 20 bp, Artificial Sequence
  Description of Artificial Sequence: Synthetic oligonucleotide
ttatttctattctttctctg

SEQ ID NO: 5265 - DNA, 20 bp, Artificial Sequence
  Description of Artificial Sequence: Synthetic oligonucleotide
tttttgttatccttttacgc

SEQ ID NO: 5266 - DNA, 20 bp, Artificial Sequence
  Description of Artificial Sequence: Synthetic oligonucleotide
tcttcttttttcactttccg

SEQ ID NO: 5267 - DNA, 21 bp, Artificial Sequence
  Description of Artificial Sequence: Synthetic oligonucleotide
ttttgctttttttttttcccc

SEQ ID NO: 5268 - DNA, 21 bp, Artificial Sequence
  Description of Artificial Sequence: Synthetic oligonucleotide
tctttttttcctatttctccg

SEQ ID NO: 5269 - DNA, 20 bp, Artificial Sequence
  Description of Artificial Sequence: Synthetic oligonucleotide
tttctctttttctcacccgc

SEQ ID NO: 5270 - DNA, 20 bp, Artificial Sequence
  Description of Artificial Sequence: Synthetic oligonucleotide
ttatttctttgttctttgcg

SEQ ID NO: 5271 - DNA, 20 bp, Artificial Sequence
  Description of Artificial Sequence: Synthetic oligonucleotide
ttgttcttgtttttattctg

SEQ ID NO: 5272 - DNA, 20 bp, Artificial Sequence
  Description of Artificial Sequence: Synthetic oligonucleotide
agttactttttacttttctg

SEQ ID NO: 5273 - DNA, 20 bp, Artificial Sequence
  Description of Artificial Sequence: Synthetic oligonucleotide
tttttatatttgtggttctg

SEQ ID NO: 5274 - DNA, 20 bp, Artificial Sequence
  Description of Artificial Sequence: Synthetic oligonucleotide
tcacttttactttttctgcg

SEQ ID NO: 5275 - DNA, 20 bp, Artificial Sequence
  Description of Artificial Sequence: Synthetic oligonucleotide
tttatcaagttttttttccg

SEQ ID NO: 5276 - DNA, 19 bp, Artificial Sequence
  Description of Artificial Sequence: Synthetic oligonucleotide
tttgtttttctcttttccg

SEQ ID NO: 5277 - DNA, 19 bp, Artificial Sequence
  Description of Artificial Sequence: Synthetic oligonucleotide
ttttacttttttttttgtg

SEQ ID NO: 5278 - DNA, 21 bp, Artificial Sequence
  Description of Artificial Sequence: Synthetic oligonucleotide
cttgtttcctttttttctccg

SEQ ID NO: 5279 - DNA, 21 bp, Artificial Sequence
  Description of Artificial Sequence: Synthetic oligonucleotide
tcttattttttctcttctccg

SEQ ID NO: 5280 - DNA, 22 bp, Artificial Sequence
  Description of Artificial Sequence: Synthetic oligonucleotide
tttcacacttttttttttgctg

SEQ ID NO: 5281 - DNA, 21 bp, Artificial Sequence
  Description of Artificial Sequence: Synthetic oligonucleotide
tcctgtcgtctgtctcgtccc

SEQ ID NO: 5282 - DNA, 21 bp, Artificial Sequence
  Description of Artificial Sequence: Synthetic oligonucleotide
tcctgtcgtcctgttcgtccc

SEQ ID NO: 5283 - DNA, 22 bp, Artificial Sequence
  Description of Artificial Sequence: Synthetic oligonucleotide
aattatgtgttttttgttaccg

SEQ ID NO: 5284 - DNA, 20 bp, Artificial Sequence
  Description of Artificial Sequence: Synthetic oligonucleotide
tcctttcgttctgccccccc

SEQ ID NO: 5285 - DNA, 20 bp, Artificial Sequence
  Description of Artificial Sequence: Synthetic oligonucleotide
tttgggagtagggtgtaccg

SEQ ID NO: 5286 - DNA, 21 bp, Artificial Sequence
  Description of Artificial Sequence: Synthetic oligonucleotide
gttttgtttttcctcgtgccg

SEQ ID NO: 5287 - DNA, 20 bp, Artificial Sequence
  Description of Artificial Sequence: Synthetic oligonucleotide
tttcttactcactttcgccg

SEQ ID NO: 5288 - DNA, 22 bp, Artificial Sequence
  Description of Artificial Sequence: Synthetic oligonucleotide
aattatgtgtttttttgtaccg

SEQ ID NO: 5289 - DNA, 20 bp, Artificial Sequence
  Description of Artificial Sequence: Synthetic oligonucleotide
tcttgtttcttctttctccg

SEQ ID NO: 5290 - DNA, 20 bp, Artificial Sequence
  Description of Artificial Sequence: Synthetic oligonucleotide
ttttacgatcctttttgccg

SEQ ID NO: 5291 - DNA, 20 bp, Artificial Sequence
  Description of Artificial Sequence: Synthetic oligonucleotide
atgtttttctctcttgaccg

SEQ ID NO: 5292 - DNA, 20 bp, Artificial Sequence
  Description of Artificial Sequence: Synthetic oligonucleotide
ttcattccattcttactccg

SEQ ID NO: 5293 - DNA, 20 bp, Artificial Sequence
  Description of Artificial Sequence: Synthetic oligonucleotide
tgtattttccctcttttccg

SEQ ID NO: 5294 - DNA, 19 bp, Artificial Sequence
  Description of Artificial Sequence: Synthetic oligonucleotide
atttcttttccttttaccg

SEQ ID NO: 5295 - DNA, 20 bp, Artificial Sequence
  Description of Artificial Sequence: Synthetic oligonucleotide
ttgggtgtagggtgttcccg

SEQ ID NO: 5296 - DNA, 20 bp, Artificial Sequence
  Description of Artificial Sequence: Synthetic oligonucleotide
ctttttttattttggctccg

SEQ ID NO: 5297 - DNA, 20 bp, Artificial Sequence
  Description of Artificial Sequence: Synthetic oligonucleotide
ctttcacgtttcttcttccg

SEQ ID NO: 5298 - DNA, 20 bp, Artificial Sequence
  Description of Artificial Sequence: Synthetic oligonucleotide
tacttcttgtttcatctccg

SEQ ID NO: 5299 - DNA, 20 bp, Artificial Sequence
  Description of Artificial Sequence: Synthetic oligonucleotide
cttttctttactcattaccg

SEQ ID NO: 5300 - DNA, 20 bp, Artificial Sequence
  Description of Artificial Sequence: Synthetic oligonucleotide
attttactaattccttaccg

SEQ ID NO: 5301 - DNA, 20 bp, Artificial Sequence
  Description of Artificial Sequence: Synthetic oligonucleotide
ttctattaaatttcactccg

SEQ ID NO: 5302 - DNA, 20 bp, Artificial Sequence
  Description of Artificial Sequence: Synthetic oligonucleotide
tttccgggttttttttgccg

SEQ ID NO: 5303 - DNA, 20 bp, Artificial Sequence
  Description of Artificial Sequence: Synthetic oligonucleotide
atttttctctttacttgccg

SEQ ID NO: 5304 - DNA, 21 bp, Artificial Sequence
  Description of Artificial Sequence: Synthetic oligonucleotide
tacttttttttttccactccg

SEQ ID NO: 5305 - DNA, 20 bp, Artificial Sequence
  Description of Artificial Sequence: Synthetic oligonucleotide
tttgaagggtgctgggtccc

SEQ ID NO: 5306 - DNA, 20 bp, Artificial Sequence
  Description of Artificial Sequence: Synthetic oligonucleotide
ctttttacattcttgctccg

SEQ ID NO: 5307 - DNA, 20 bp, Artificial Sequence
  Description of Artificial Sequence: Synthetic oligonucleotide
ctctttctttttttgctccc

SEQ ID NO: 5308 - DNA, 20 bp, Artificial Sequence
  Description of Artificial Sequence: Synthetic oligonucleotide
ttttatttttccctatcccg

SEQ ID NO: 5309 - DNA, 20 bp, Artificial Sequence
  Description of Artificial Sequence: Synthetic oligonucleotide
ctttatactgcaagccgtac

SEQ ID NO: 5310 - DNA, 20 bp, Artificial Sequence
  Description of Artificial Sequence: Synthetic oligonucleotide
gtatgctttctctttttccg

SEQ ID NO: 5311 - DNA, 20 bp, Artificial Sequence
  Description of Artificial Sequence: Synthetic oligonucleotide
tttccttttgcttacttctg

SEQ ID NO: 5312 - DNA, 20 bp, Artificial Sequence
  Description of Artificial Sequence: Synthetic oligonucleotide
ttcatattttcactttcccg

SEQ ID NO: 5313 - DNA, 20 bp, Artificial Sequence
  Description of Artificial Sequence: Synthetic oligonucleotide
ctatatggaggaggtggagc

SEQ ID NO: 5314 - DNA, 20 bp, Artificial Sequence
  Description of Artificial Sequence: Synthetic oligonucleotide
gctttctcacttttttcccc

SEQ ID NO: 5315 - DNA, 19 bp, Artificial Sequence
  Description of Artificial Sequence: Synthetic oligonucleotide
tcctgcgtctgttcgtccc

SEQ ID NO: 5316 - DNA, 20 bp, Artificial Sequence
  Description of Artificial Sequence: Synthetic oligonucleotide
ctttttgtatcttctttccg

SEQ ID NO: 5317 - DNA, 21 bp, Artificial Sequence
  Description of Artificial Sequence: Synthetic oligonucleotide
tgagtcacatttttttacccc

SEQ ID NO: 5318 - DNA, 20 bp, Artificial Sequence
  Description of Artificial Sequence: Synthetic oligonucleotide
acactttttcctcttttccc

SEQ ID NO: 5319 - DNA, 20 bp, Artificial Sequence
  Description of Artificial Sequence: Synthetic oligonucleotide
tttccctttacttttttccg

SEQ ID NO: 5320 - DNA, 20 bp, Artificial Sequence
  Description of Artificial Sequence: Synthetic oligonucleotide
tctattttcttctacttccg

SEQ ID NO: 5321 - DNA, 20 bp, Artificial Sequence
  Description of Artificial Sequence: Synthetic oligonucleotide
ctttattattattcactccg

SEQ ID NO: 5322 - DNA, 20 bp, Artificial Sequence
  Description of Artificial Sequence: Synthetic oligonucleotide
ttcttatcattccctttccg

SEQ ID NO: 5323 - DNA, 21 bp, Artificial Sequence
  Description of Artificial Sequence: Synthetic oligonucleotide
atttattttttttgcgccccg

SEQ ID NO: 5324 - DNA, 20 bp, Artificial Sequence
  Description of Artificial Sequence: Synthetic oligonucleotide
ttctttgtcttttgtttgcc

SEQ ID NO: 5325 - DNA, 20 bp, Artificial Sequence
  Description of Artificial Sequence: Synthetic oligonucleotide
tttttatttgtacttttcgc

SEQ ID NO: 5326 - DNA, 20 bp, Artificial Sequence
  Description of Artificial Sequence: Synthetic oligonucleotide
attatttccattccttaccg

SEQ ID NO: 5327 - DNA, 21 bp, Artificial Sequence
  Description of Artificial Sequence: Synthetic oligonucleotide
ttattgcttttttttggtccg

SEQ ID NO: 5328 - DNA, 20 bp, Artificial Sequence
  Description of Artificial Sequence: Synthetic oligonucleotide
tgtttttcgtattttttccg

SEQ ID NO: 5329 - DNA, 19 bp, Artificial Sequence
  Description of Artificial Sequence: Synthetic oligonucleotide
ctttattattcttttaccg

SEQ ID NO: 5330 - DNA, 20 bp, Artificial Sequence
  Description of Artificial Sequence: Synthetic oligonucleotide
ttatttgtttattttctcgc

SEQ ID NO: 5331 - DNA, 21 bp, Artificial Sequence
  Description of Artificial Sequence: Synthetic oligonucleotide
atctacactttttttttcccg

SEQ ID NO: 5332 - DNA, 20 bp, Artificial Sequence
  Description of Artificial Sequence: Synthetic oligonucleotide
tttgcttttttttttatccg

SEQ ID NO: 5333 - DNA, 20 bp, Artificial Sequence
  Description of Artificial Sequence: Synthetic oligonucleotide
ttttctcgcttcactttccg

SEQ ID NO: 5334 - DNA, 20 bp, Artificial Sequence
  Description of Artificial Sequence: Synthetic oligonucleotide
cataggagtagggaggtttg

SEQ ID NO: 5335 - DNA, 20 bp, Artificial Sequence
  Description of Artificial Sequence: Synthetic oligonucleotide
atttattttcttggctgccg

SEQ ID NO: 5336 - DNA, 20 bp, Artificial Sequence
  Description of Artificial Sequence: Synthetic oligonucleotide
tctctctacttcttttgccg

SEQ ID NO: 5337 - DNA, 20 bp, Artificial Sequence
  Description of Artificial Sequence: Synthetic oligonucleotide
gttctaatactctctttccg

SEQ ID NO: 5338 - DNA, 20 bp, Artificial Sequence
  Description of Artificial Sequence: Synthetic oligonucleotide
ttcgtgttttctttttgctg

SEQ ID NO: 5339 - DNA, 20 bp, Artificial Sequence
  Description of Artificial Sequence: Synthetic oligonucleotide
tctttatgcttttgtctccg

SEQ ID NO: 5340 - DNA, 20 bp, Artificial Sequence
  Description of Artificial Sequence: Synthetic oligonucleotide
atttctgattatttttaccg

SEQ ID NO: 5341 - DNA, 20 bp, Artificial Sequence
  Description of Artificial Sequence: Synthetic oligonucleotide
tttatttttgctgttttccg

SEQ ID NO: 5342 - DNA, 20 bp, Artificial Sequence
  Description of Artificial Sequence: Synthetic oligonucleotide
aatttacatcttttttgccg

SEQ ID NO: 5343 - DNA, 20 bp, Artificial Sequence
  Description of Artificial Sequence: Synthetic oligonucleotide
ccttttatttcttttttccc

SEQ ID NO: 5344 - DNA, 20 bp, Artificial Sequence
  Description of Artificial Sequence: Synthetic oligonucleotide
ttttgttttctttcacgcgc

SEQ ID NO: 5345 - DNA, 20 bp, Artificial Sequence
  Description of Artificial Sequence: Synthetic oligonucleotide
ttcttatttccttttccgcc

SEQ ID NO: 5346 - DNA, 20 bp, Artificial Sequence
  Description of Artificial Sequence: Synthetic oligonucleotide
tctttgcttttcgttttccg

SEQ ID NO: 5347 - DNA, 20 bp, Artificial Sequence
  Description of Artificial Sequence: Synthetic oligonucleotide
tttttgtatgattttctccg

SEQ ID NO: 5348 - DNA, 20 bp, Artificial Sequence
  Description of Artificial Sequence: Synthetic oligonucleotide
ttcattctgtttttctcctg

SEQ ID NO: 5349 - DNA, 20 bp, Artificial Sequence
  Description of Artificial Sequence: Synthetic oligonucleotide
tctctttattttcctacccg

SEQ ID NO: 5350 - DNA, 22 bp, Artificial Sequence
  Description of Artificial Sequence: Synthetic oligonucleotide
ccttttactttttttttctccg

SEQ ID NO: 5351 - DNA, 19 bp, Artificial Sequence
  Description of Artificial Sequence: Synthetic oligonucleotide
tttcttgtctatttttccg

SEQ ID NO: 5352 - DNA, 20 bp, Artificial Sequence
  Description of Artificial Sequence: Synthetic oligonucleotide
tttcaccttattcctttctg

SEQ ID NO: 5353 - DNA, 20 bp, Artificial Sequence
  Description of Artificial Sequence: Synthetic oligonucleotide
cttttatcttctatcctccg

SEQ ID NO: 5354 - DNA, 20 bp, Artificial Sequence
  Description of Artificial Sequence: Synthetic oligonucleotide
ccttatctattttcttaccg

SEQ ID NO: 5355 - DNA, 21 bp, Artificial Sequence
  Description of Artificial Sequence: Synthetic oligonucleotide
ttcttgctttatttttttccg

SEQ ID NO: 5356 - DNA, 20 bp, Artificial Sequence
  Description of Artificial Sequence: Synthetic oligonucleotide
attcttttttcttattcccg

SEQ ID NO: 5357 - DNA, 20 bp, Artificial Sequence
  Description of Artificial Sequence: Synthetic oligonucleotide
atttcacttttttccttcgc

SEQ ID NO: 5358 - DNA, 21 bp, Artificial Sequence
  Description of Artificial Sequence: Synthetic oligonucleotide
actttcatatttttttcaccg

SEQ ID NO: 5359 - DNA, 20 bp, Artificial Sequence
  Description of Artificial Sequence: Synthetic oligonucleotide
cacatttctcattttatccg

SEQ ID NO: 5360 - DNA, 20 bp, Artificial Sequence
  Description of Artificial Sequence: Synthetic oligonucleotide
ctttttcaaatttttctccg

SEQ ID NO: 5361 - DNA, 20 bp, Artificial Sequence
  Description of Artificial Sequence: Synthetic oligonucleotide
tcatttttatttcttttcgc

SEQ ID NO: 5362 - DNA, 19 bp, Artificial Sequence
  Description of Artificial Sequence: Synthetic oligonucleotide
tgttttcttctgttttgcg

SEQ ID NO: 5363 - DNA, 20 bp, Artificial Sequence
  Description of Artificial Sequence: Synthetic oligonucleotide
ttttatttatttccgtcccg

SEQ ID NO: 5364 - DNA, 20 bp, Artificial Sequence
  Description of Artificial Sequence: Synthetic oligonucleotide
catctttctttattactccg

SEQ ID NO: 5365 - DNA, 22 bp, Artificial Sequence
  Description of Artificial Sequence: Synthetic oligonucleotide
gatacttttttttttttgcccc

SEQ ID NO: 5366 - DNA, 21 bp, Artificial Sequence
  Description of Artificial Sequence: Synthetic oligonucleotide
ttagtgtttagtttttttgtg

SEQ ID NO: 5367 - DNA, 20 bp, Artificial Sequence
  Description of Artificial Sequence: Synthetic oligonucleotide
accttttgtttctatttccg

SEQ ID NO: 5368 - DNA, 20 bp, Artificial Sequence
  Description of Artificial Sequence: Synthetic oligonucleotide
cattctctaatttttctccg

SEQ ID NO: 5369 - DNA, 20 bp, Artificial Sequence
  Description of Artificial Sequence: Synthetic oligonucleotide
tcactttattctattctctg

SEQ ID NO: 5370 - DNA, 20 bp, Artificial Sequence
  Description of Artificial Sequence: Synthetic oligonucleotide
tttggggttttcccgagccc

SEQ ID NO: 5371 - DNA, 20 bp, Artificial Sequence
  Description of Artificial Sequence: Synthetic oligonucleotide
tttgaggttttcccgtgccc

SEQ ID NO: 5372 - DNA, 19 bp, Artificial Sequence
  Description of Artificial Sequence: Synthetic oligonucleotide
tgagtcgttcccttgtccc

SEQ ID NO: 5373 - DNA, 20 bp, Artificial Sequence
  Description of Artificial Sequence: Synthetic oligonucleotide
tccttgtcgtcctgcgtccc

SEQ ID NO: 5374 - DNA, 20 bp, Artificial Sequence
  Description of Artificial Sequence: Synthetic oligonucleotide
tttaggagtagggtgttccg

SEQ ID NO: 5375 - DNA, 20 bp, Artificial Sequence
  Description of Artificial Sequence: Synthetic oligonucleotide
tcctttcgtcctgccctccc

SEQ ID NO: 5376 - DNA, 20 bp, Artificial Sequence
  Description of Artificial Sequence: Synthetic oligonucleotide
tttgggaatagggtgttccg

SEQ ID NO: 5377 - DNA, 20 bp, Artificial Sequence
  Description of Artificial Sequence: Synthetic oligonucleotide
atttcctttctctgttgccg

SEQ ID NO: 5378 - DNA, 20 bp, Artificial Sequence
  Description of Artificial Sequence: Synthetic oligonucleotide
gctttcttcctgtttctccg

SEQ ID NO: 5379 - DNA, 20 bp, Artificial Sequence
  Description of Artificial Sequence: Synthetic oligonucleotide
atccgtttgttctttctccg

SEQ ID NO: 5380 - DNA, 19 bp, Artificial Sequence
  Description of Artificial Sequence: Synthetic oligonucleotide
attttctctttttctgccg

SEQ ID NO: 5381 - DNA, 20 bp, Artificial Sequence
  Description of Artificial Sequence: Synthetic oligonucleotide
ccactattgtcttttctccg

SEQ ID NO: 5382 - DNA, 20 bp, Artificial Sequence
  Description of Artificial Sequence: Synthetic oligonucleotide
cctttgctcttttccctccg

SEQ ID NO: 5383 - DNA, 19 bp, Artificial Sequence
  Description of Artificial Sequence: Synthetic oligonucleotide
ttttccgttcctttttccg

SEQ ID NO: 5384 - DNA, 22 bp, Artificial Sequence
  Description of Artificial Sequence: Synthetic oligonucleotide
atcctttatttttctcacgccg

SEQ ID NO: 5385 - DNA, 20 bp, Artificial Sequence
  Description of Artificial Sequence: Synthetic oligonucleotide
acttctcctacttttctccg

SEQ ID NO: 5386 - DNA, 20 bp, Artificial Sequence
  Description of Artificial Sequence: Synthetic oligonucleotide
gattttaactttcctctccc

SEQ ID NO: 5387 - DNA, 20 bp, Artificial Sequence
  Description of Artificial Sequence: Synthetic oligonucleotide
ccctttaatcttcttttccg

SEQ ID NO: 5388 - DNA, 20 bp, Artificial Sequence
  Description of Artificial Sequence: Synthetic oligonucleotide
tttctactcctttcactccg

SEQ ID NO: 5389 - DNA, 19 bp, Artificial Sequence
  Description of Artificial Sequence: Synthetic oligonucleotide
attttcttcttctttaccg

SEQ ID NO: 5390 - DNA, 20 bp, Artificial Sequence
  Description of Artificial Sequence: Synthetic oligonucleotide
ctttctctttcatgcttccg

SEQ ID NO: 5391 - DNA, 20 bp, Artificial Sequence
  Description of Artificial Sequence: Synthetic oligonucleotide
gttgccttcacttttttccg

SEQ ID NO: 5392 - DNA, 20 bp, Artificial Sequence
  Description of Artificial Sequence: Synthetic oligonucleotide
cttattctttccgttttccg

SEQ ID NO: 5393 - DNA, 20 bp, Artificial Sequence
  Description of Artificial Sequence: Synthetic oligonucleotide
tttattttggtacctttccg

SEQ ID NO: 5394 - DNA, 20 bp, Artificial Sequence
  Description of Artificial Sequence: Synthetic oligonucleotide
cttcgttatttcttcttccg

SEQ ID NO: 5395 - DNA, 20 bp, Artificial Sequence
  Description of Artificial Sequence: Synthetic oligonucleotide
tttccgatttctttttgccc

SEQ ID NO: 5396 - DNA, 20 bp, Artificial Sequence
  Description of Artificial Sequence: Synthetic oligonucleotide
catcttatttttcttatccg

SEQ ID NO: 5397 - DNA, 20 bp, Artificial Sequence
  Description of Artificial Sequence: Synthetic oligonucleotide
atactcttttcctttttgcc

SEQ ID NO: 5398 - DNA, 20 bp, Artificial Sequence
  Description of Artificial Sequence: Synthetic oligonucleotide
tttttctcttttctgctgcc

SEQ ID NO: 5399 - DNA, 20 bp, Artificial Sequence
  Description of Artificial Sequence: Synthetic oligonucleotide
ttcttacttactcttctctg

SEQ ID NO: 5400 - DNA, 20 bp, Artificial Sequence
  Description of Artificial Sequence: Synthetic oligonucleotide
tgtttttgctatttcttgcc

SEQ ID NO: 5401 - DNA, 20 bp, Artificial Sequence
  Description of Artificial Sequence: Synthetic oligonucleotide
tgatttatttgtttttgcac

SEQ ID NO: 5402 - DNA, 20 bp, Artificial Sequence
  Description of Artificial Sequence: Synthetic oligonucleotide
ttctgtcttctttttacccg

SEQ ID NO: 5403 - DNA, 20 bp, Artificial Sequence
  Description of Artificial Sequence: Synthetic oligonucleotide
atttacatctttcgctcccg

SEQ ID NO: 5404 - DNA, 20 bp, Artificial Sequence
  Description of Artificial Sequence: Synthetic oligonucleotide
tatttatcctttcttctgtg

SEQ ID NO: 5405 - DNA, 20 bp, Artificial Sequence
  Description of Artificial Sequence: Synthetic oligonucleotide
cattgttttattttccccgc

SEQ ID NO: 5406 - DNA, 20 bp, Artificial Sequence
  Description of Artificial Sequence: Synthetic oligonucleotide
ccttttactttttttccccg

SEQ ID NO: 5407 - DNA, 22 bp, Artificial Sequence
  Description of Artificial Sequence: Synthetic oligonucleotide
cttttttcattcccttttgccg

SEQ ID NO: 5408 - DNA, 20 bp, Artificial Sequence
  Description of Artificial Sequence: Synthetic oligonucleotide
tttgtttttctccttttccg

SEQ ID NO: 5409 - DNA, 20 bp, Artificial Sequence
  Description of Artificial Sequence: Synthetic oligonucleotide
ttcaattctttacttttccc

SEQ ID NO: 5410 - DNA, 21 bp, Artificial Sequence
  Description of Artificial Sequence: Synthetic oligonucleotide
tctttttttcttctacccccg

SEQ ID NO: 5411 - DNA, 20 bp, Artificial Sequence
  Description of Artificial Sequence: Synthetic oligonucleotide
aacttttattgcttttaccc

SEQ ID NO: 5412 - DNA, 21 bp, Artificial Sequence
  Description of Artificial Sequence: Synthetic oligonucleotide
gatactttttttttttgcccc

SEQ ID NO: 5413 - DNA, 20 bp, Artificial Sequence
  Description of Artificial Sequence: Synthetic oligonucleotide
tcatactttttttcgctctg

SEQ ID NO: 5414 - DNA, 20 bp, Artificial Sequence
  Description of Artificial Sequence: Synthetic oligonucleotide
ccacgtttattttttatccg

SEQ ID NO: 5415 - DNA, 20 bp, Artificial Sequence
  Description of Artificial Sequence: Synthetic oligonucleotide
ctttttatgttctttttccc

SEQ ID NO: 5416 - DNA, 20 bp, Artificial Sequence
  Description of Artificial Sequence: Synthetic oligonucleotide
ctttattttcatgcttaccg

SEQ ID NO: 5417 - DNA, 20 bp, Artificial Sequence
  Description of Artificial Sequence: Synthetic oligonucleotide
attaactctttcctttaccg

SEQ ID NO: 5418 - DNA, 20 bp, Artificial Sequence
  Description of Artificial Sequence: Synthetic oligonucleotide
gtttttagtttttgtttccc

SEQ ID NO: 5419 - DNA, 20 bp, Artificial Sequence
  Description of Artificial Sequence: Synthetic oligonucleotide
cctttttcttccttttacgc

SEQ ID NO: 5420 - DNA, 20 bp, Artificial Sequence
  Description of Artificial Sequence: Synthetic oligonucleotide
aattgttctcttttcatccg

SEQ ID NO: 5421 - DNA, 20 bp, Artificial Sequence
  Description of Artificial Sequence: Synthetic oligonucleotide
ttattacttatctttctgtg

SEQ ID NO: 5422 - DNA, 20 bp, Artificial Sequence
  Description of Artificial Sequence: Synthetic oligonucleotide
attttcagcgttttttcccg

SEQ ID NO: 5423 - DNA, 20 bp, Artificial Sequence
  Description of Artificial Sequence: Synthetic oligonucleotide
aatcttctcattttcgtccg

SEQ ID NO: 5424 - DNA, 20 bp, Artificial Sequence
  Description of Artificial Sequence: Synthetic oligonucleotide
attatactttccttttaccc

SEQ ID NO: 5425 - DNA, 20 bp, Artificial Sequence
  Description of Artificial Sequence: Synthetic oligonucleotide
ccttttctatacttcatccg

SEQ ID NO: 5426 - DNA, 20 bp, Artificial Sequence
  Description of Artificial Sequence: Synthetic oligonucleotide
ttacttattcctttctcccg

SEQ ID NO: 5427 - DNA, 21 bp, Artificial Sequence
  Description of Artificial Sequence: Synthetic oligonucleotide
ttttttcacggtttttttctg

SEQ ID NO: 5428 - DNA, 20 bp, Artificial Sequence
  Description of Artificial Sequence: Synthetic oligonucleotide
tttgtttctctctttttccg

SEQ ID NO: 5429 - DNA, 20 bp, Artificial Sequence
  Description of Artificial Sequence: Synthetic oligonucleotide
ctcttcttgtctcttttccg

SEQ ID NO: 5430 - DNA, 20 bp, Artificial Sequence
  Description of Artificial Sequence: Synthetic oligonucleotide
gttcttcttctgtttttccg

SEQ ID NO: 5431 - DNA, 20 bp, Artificial Sequence
  Description of Artificial Sequence: Synthetic oligonucleotide
ttacttttatgctttttccg

SEQ ID NO: 5432 - DNA, 20 bp, Artificial Sequence
  Description of Artificial Sequence: Synthetic oligonucleotide
tttcttattctatccctctg

SEQ ID NO: 5433 - DNA, 20 bp, Artificial Sequence
  Description of Artificial Sequence: Synthetic oligonucleotide
ttttactctctctttttctg

SEQ ID NO: 5434 - DNA, 20 bp, Artificial Sequence
  Description of Artificial Sequence: Synthetic oligonucleotide
attttttccctttattaccg

SEQ ID NO: 5435 - DNA, 20 bp, Artificial Sequence
  Description of Artificial Sequence: Synthetic oligonucleotide
tcttaaatcttttccatccg

SEQ ID NO: 5436 - DNA, 20 bp, Artificial Sequence
  Description of Artificial Sequence: Synthetic oligonucleotide
tttgtgtgttctttttcccg

SEQ ID NO: 5437 - DNA, 20 bp, Artificial Sequence
  Description of Artificial Sequence: Synthetic oligonucleotide
ccatttaacttttttctctg

SEQ ID NO: 5438 - DNA, 20 bp, Artificial Sequence
  Description of Artificial Sequence: Synthetic oligonucleotide
ctttacactccatctttccg

SEQ ID NO: 5439 - DNA, 20 bp, Artificial Sequence
  Description of Artificial Sequence: Synthetic oligonucleotide
tctattataccttttccccg

SEQ ID NO: 5440 - DNA, 20 bp, Artificial Sequence
  Description of Artificial Sequence: Synthetic oligonucleotide
atttatctcaatttctaccg

SEQ ID NO: 5441 - DNA, 20 bp, Artificial Sequence
  Description of Artificial Sequence: Synthetic oligonucleotide
ccttactctactcttatccg

SEQ ID NO: 5442 - DNA, 20 bp, Artificial Sequence
  Description of Artificial Sequence: Synthetic oligonucleotide
tttttttttgtcttgctccg

SEQ ID NO: 5443 - DNA, 20 bp, Artificial Sequence
  Description of Artificial Sequence: Synthetic oligonucleotide
actttcaatttttctcaccc

SEQ ID NO: 5444 - DNA, 20 bp, Artificial Sequence
  Description of Artificial Sequence: Synthetic oligonucleotide
ttttctttaatttctttccc

SEQ ID NO: 5445 - DNA, 20 bp, Artificial Sequence
  Description of Artificial Sequence: Synthetic oligonucleotide
ttttgtttattacttttgtg

SEQ ID NO: 5446 - DNA, 20 bp, Artificial Sequence
  Description of Artificial Sequence: Synthetic oligonucleotide
gtcctgtcgtcttgcgtccc

SEQ ID NO: 5447 - DNA, 20 bp, Artificial Sequence
  Description of Artificial Sequence: Synthetic oligonucleotide
tccggtcggctgttcgtccc

SEQ ID NO: 5448 - DNA, 20 bp, Artificial Sequence
  Description of Artificial Sequence: Synthetic oligonucleotide
tcccgtcgtctttgcgtccc

SEQ ID NO: 5449 - DNA, 20 bp, Artificial Sequence
  Description of Artificial Sequence: Synthetic oligonucleotide
tccttgccgtcttgcgtccc

SEQ ID NO: 5450 - DNA, 20 bp, Artificial Sequence
  Description of Artificial Sequence: Synthetic oligonucleotide
attctcttctcctcgctccg

SEQ ID NO: 5451 - DNA, 19 bp, Artificial Sequence
  Description of Artificial Sequence: Synthetic oligonucleotide
attccttttcttttctccg

SEQ ID NO: 5452 - DNA, 18 bp, Artificial Sequence
  Description of Artificial Sequence: Synthetic oligonucleotide
tcctgtcgtctccgtccc

SEQ ID NO: 5453 - DNA, 21 bp, Artificial Sequence
  Description of Artificial Sequence: Synthetic oligonucleotide
tgtttcctttttccttcgccc

SEQ ID NO: 5454 - DNA, 21 bp, Artificial Sequence
  Description of Artificial Sequence: Synthetic oligonucleotide
tcctgtcgtctgttcggtccc

SEQ ID NO: 5455 - DNA, 20 bp, Artificial Sequence
  Description of Artificial Sequence: Synthetic oligonucleotide
tttgagagtagggtgttccg

SEQ ID NO: 5456 - DNA, 20 bp, Artificial Sequence
  Description of Artificial Sequence: Synthetic oligonucleotide
gcttttcgttcttccctccc

SEQ ID NO: 5457 - DNA, 20 bp, Artificial Sequence
  Description of Artificial Sequence: Synthetic oligonucleotide
caaatggaggtgtagggtgc

SEQ ID NO: 5458 - DNA, 20 bp, Artificial Sequence
  Description of Artificial Sequence: Synthetic oligonucleotide
gttttcttttactgtctccg

SEQ ID NO: 5459 - DNA, 19 bp, Artificial Sequence
  Description of Artificial Sequence: Synthetic oligonucleotide
ttgtgcgttttttttgccg

SEQ ID NO: 5460 - DNA, 20 bp, Artificial Sequence
  Description of Artificial Sequence: Synthetic oligonucleotide
tcatttgtctttatcctccg

SEQ ID NO: 5461 - DNA, 19 bp, Artificial Sequence
  Description of Artificial Sequence: Synthetic oligonucleotide
attttctctttttttgccg

SEQ ID NO: 5462 - DNA, 20 bp, Artificial Sequence
  Description of Artificial Sequence: Synthetic oligonucleotide
ttttggagtagggtgttccg

SEQ ID NO: 5463 - DNA, 20 bp, Artificial Sequence
  Description of Artificial Sequence: Synthetic oligonucleotide
tttttgttatctctctgcgc

SEQ ID NO: 5464 - DNA, 21 bp, Artificial Sequence
  Description of Artificial Sequence: Synthetic oligonucleotide
gatttcgctcatttttttgcc

SEQ ID NO: 5465 - DNA, 20 bp, Artificial Sequence
  Description of Artificial Sequence: Synthetic oligonucleotide
ttttctcgctttctccgccg

SEQ ID NO: 5466 - DNA, 22 bp, Artificial Sequence
  Description of Artificial Sequence: Synthetic oligonucleotide
tccatgctttttttttttgccg

SEQ ID NO: 5467 - DNA, 20 bp, Artificial Sequence
  Description of Artificial Sequence: Synthetic oligonucleotide
ttacttttttcttcctgccg

SEQ ID NO: 5468 - DNA, 20 bp, Artificial Sequence
  Description of Artificial Sequence: Synthetic oligonucleotide
ctcttcataccatttctccg

SEQ ID NO: 5469 - DNA, 20 bp, Artificial Sequence
  Description of Artificial Sequence: Synthetic oligonucleotide
cttgtgtttttttttttgcc

SEQ ID NO: 5470 - DNA, 20 bp, Artificial Sequence
  Description of Artificial Sequence: Synthetic oligonucleotide
tttcactttgactttttgcc

SEQ ID NO: 5471 - DNA, 20 bp, Artificial Sequence
  Description of Artificial Sequence: Synthetic oligonucleotide
gttcgtgtttcttctttccg

SEQ ID NO: 5472 - DNA, 20 bp, Artificial Sequence
  Description of Artificial Sequence: Synthetic oligonucleotide
tttttttattgattgctccg

SEQ ID NO: 5473 - DNA, 20 bp, Artificial Sequence
  Description of Artificial Sequence: Synthetic oligonucleotide
atattgtctctttttttccg

SEQ ID NO: 5474 - DNA, 20 bp, Artificial Sequence
  Description of Artificial Sequence: Synthetic oligonucleotide
gttttgtttgttgtttcccg

SEQ ID NO: 5475 - DNA, 19 bp, Artificial Sequence
  Description of Artificial Sequence: Synthetic oligonucleotide
ttggggttttcccgtgccg

SEQ ID NO: 5476 - DNA, 20 bp, Artificial Sequence
  Description of Artificial Sequence: Synthetic oligonucleotide
tctttcactcttattatccg

SEQ ID NO: 5477 - DNA, 20 bp, Artificial Sequence
  Description of Artificial Sequence: Synthetic oligonucleotide
attcctttctcttttcaccg

SEQ ID NO: 5478 - DNA, 21 bp, Artificial Sequence
  Description of Artificial Sequence: Synthetic oligonucleotide
ttactttcttttttcccaccc

SEQ ID NO: 5479 - DNA, 21 bp, Artificial Sequence
  Description of Artificial Sequence: Synthetic oligonucleotide
gttgctttttatgttttaccg

SEQ ID NO: 5480 - DNA, 20 bp, Artificial Sequence
  Description of Artificial Sequence: Synthetic oligonucleotide
tttcatctattctacttccg

SEQ ID NO: 5481 - DNA, 21 bp, Artificial Sequence
  Description of Artificial Sequence: Synthetic oligonucleotide
actctttttttgcttcttccg

SEQ ID NO: 5482 - DNA, 21 bp, Artificial Sequence
  Description of Artificial Sequence: Synthetic oligonucleotide
agtttcgtgttttttttgccc

SEQ ID NO: 5483 - DNA, 21 bp, Artificial Sequence
  Description of Artificial Sequence: Synthetic oligonucleotide
ttttccgaagtcttttttccg

SEQ ID NO: 5484 - DNA, 21 bp, Artificial Sequence
  Description of Artificial Sequence: Synthetic oligonucleotide
attccacttttttttccaccg

SEQ ID NO: 5485 - DNA, 20 bp, Artificial Sequence
  Description of Artificial Sequence: Synthetic oligonucleotide
tcatttttccagtttttccc

SEQ ID NO: 5486 - DNA, 20 bp, Artificial Sequence
  Description of Artificial Sequence: Synthetic oligonucleotide
actttatttcccttattctg

SEQ ID NO: 5487 - DNA, 20 bp, Artificial Sequence
  Description of Artificial Sequence: Synthetic oligonucleotide
tactatttttacttcctccg

SEQ ID NO: 5488 - DNA, 20 bp, Artificial Sequence
  Description of Artificial Sequence: Synthetic oligonucleotide
cttttctttctccttcaccg

SEQ ID NO: 5489 - DNA, 20 bp, Artificial Sequence
  Description of Artificial Sequence: Synthetic oligonucleotide
ttatttttgtttgtttgtcc

SEQ ID NO: 5490 - DNA, 22 bp, Artificial Sequence
  Description of Artificial Sequence: Synthetic oligonucleotide
ttttcacttcattttttttgcc

SEQ ID NO: 5491 - DNA, 20 bp, Artificial Sequence
  Description of Artificial Sequence: Synthetic oligonucleotide
atttaatcctttcttcaccg

SEQ ID NO: 5492 - DNA, 20 bp, Artificial Sequence
  Description of Artificial Sequence: Synthetic oligonucleotide
cttctttattcttttctctg

SEQ ID NO: 5493 - DNA, 20 bp, Artificial Sequence
  Description of Artificial Sequence: Synthetic oligonucleotide
gttttccgtgctcttttccg

SEQ ID NO: 5494 - DNA, 20 bp, Artificial Sequence
  Description of Artificial Sequence: Synthetic oligonucleotide
tattctttctttttcaaccc

SEQ ID NO: 5495 - DNA, 20 bp, Artificial Sequence
  Description of Artificial Sequence: Synthetic oligonucleotide
tttttagctgtctttttccg

SEQ ID NO: 5496 - DNA, 20 bp, Artificial Sequence
  Description of Artificial Sequence: Synthetic oligonucleotide
atttttgtttcgtttgcctg

SEQ ID NO: 5497 - DNA, 20 bp, Artificial Sequence
  Description of Artificial Sequence: Synthetic oligonucleotide
gtttactttttactctgccg

SEQ ID NO: 5498 - DNA, 20 bp, Artificial Sequence
  Description of Artificial Sequence: Synthetic oligonucleotide
actttactcttcctttaccg

SEQ ID NO: 5499 - DNA, 20 bp, Artificial Sequence
  Description of Artificial Sequence: Synthetic oligonucleotide
gtactatttctttccttccg

SEQ ID NO: 5500 - DNA, 20 bp, Artificial Sequence
  Description of Artificial Sequence: Synthetic oligonucleotide
acttttcctgacttattccg

SEQ ID NO: 5501 - DNA, 20 bp, Artificial Sequence
  Description of Artificial Sequence: Synthetic oligonucleotide
cattcttttttacttttccc

SEQ ID NO: 5502 - DNA, 22 bp, Artificial Sequence
  Description of Artificial Sequence: Synthetic oligonucleotide
tttttgttacgttttttttgcg

SEQ ID NO: 5503 - DNA, 20 bp, Artificial Sequence
  Description of Artificial Sequence: Synthetic oligonucleotide
gtccatattttcttcttccg

SEQ ID NO: 5504 - DNA, 20 bp, Artificial Sequence
  Description of Artificial Sequence: Synthetic oligonucleotide
ttatttttattttccctgta

SEQ ID NO: 5505 - DNA, 20 bp, Artificial Sequence
  Description of Artificial Sequence: Synthetic oligonucleotide
ttttcatgaagttttttccg

SEQ ID NO: 5506 - DNA, 20 bp, Artificial Sequence
  Description of Artificial Sequence: Synthetic oligonucleotide
attttttgtttcctttgccg

SEQ ID NO: 5507 - DNA, 21 bp, Artificial Sequence
  Description of Artificial Sequence: Synthetic oligonucleotide
tttttctactctttttttccg

SEQ ID NO: 5508 - DNA, 20 bp, Artificial Sequence
  Description of Artificial Sequence: Synthetic oligonucleotide
cttttttcgtctcttttccg

SEQ ID NO: 5509 - DNA, 21 bp, Artificial Sequence
  Description of Artificial Sequence: Synthetic oligonucleotide
ttattttccttttttctgccg

SEQ ID NO: 5510 - DNA, 20 bp, Artificial Sequence
  Description of Artificial Sequence: Synthetic oligonucleotide
tatgttctttttttgtcccg

SEQ ID NO: 5511 - DNA, 18 bp, Artificial Sequence
  Description of Artificial Sequence: Synthetic oligonucleotide
attttcttcttcttaccg

SEQ ID NO: 5512 - DNA, 20 bp, Artificial Sequence
  Description of Artificial Sequence: Synthetic oligonucleotide
attacttaatactttttgcc

SEQ ID NO: 5513 - DNA, 20 bp, Artificial Sequence
  Description of Artificial Sequence: Synthetic oligonucleotide
ctttctctctatttattccg

SEQ ID NO: 5514 - DNA, 20 bp, Artificial Sequence
  Description of Artificial Sequence: Synthetic oligonucleotide
ttctaatcatttcttttccc

SEQ ID NO: 5515 - DNA, 20 bp, Artificial Sequence
  Description of Artificial Sequence: Synthetic oligonucleotide
ttttatttctttccattccc

SEQ ID NO: 5516 - DNA, 21 bp, Artificial Sequence
  Description of Artificial Sequence: Synthetic oligonucleotide
acttctttattttttcttccg

SEQ ID NO: 5517 - DNA, 20 bp, Artificial Sequence
  Description of Artificial Sequence: Synthetic oligonucleotide
atattcttttttctcagctg

SEQ ID NO: 5518 - DNA, 20 bp, Artificial Sequence
  Description of Artificial Sequence: Synthetic oligonucleotide
acatcattttctttttaccc

SEQ ID NO: 5519 - DNA, 21 bp, Artificial Sequence
  Description of Artificial Sequence: Synthetic oligonucleotide
ttttcacttttttttcggctg

SEQ ID NO: 5520 - DNA, 20 bp, Artificial Sequence
  Description of Artificial Sequence: Synthetic oligonucleotide
ttttcctagttttttccccg

SEQ ID NO: 5521 - DNA, 20 bp, Artificial Sequence
  Description of Artificial Sequence: Synthetic oligonucleotide
cctttttactttctcttccg

SEQ ID NO: 5522 - DNA, 20 bp, Artificial Sequence
  Description of Artificial Sequence: Synthetic oligonucleotide
tttgttttcctctttttccg

SEQ ID NO: 5523 - DNA, 20 bp, Artificial Sequence
  Description of Artificial Sequence: Synthetic oligonucleotide
ctttcttgctctctttcccg

SEQ ID NO: 5524 - DNA, 20 bp, Artificial Sequence
  Description of Artificial Sequence: Synthetic oligonucleotide
ttttattacttcttgttctg

SEQ ID NO: 5525 - DNA, 20 bp, Artificial Sequence
  Description of Artificial Sequence: Synthetic oligonucleotide
ttttaattttttccttcgtg

SEQ ID NO: 5526 - DNA, 20 bp, Artificial Sequence
  Description of Artificial Sequence: Synthetic oligonucleotide
gctttttttctctttccctg

SEQ ID NO: 5527 - DNA, 20 bp, Artificial Sequence
  Description of Artificial Sequence: Synthetic oligonucleotide
ttttcactatttttattcgc

SEQ ID NO: 5528 - DNA, 20 bp, Artificial Sequence
  Description of Artificial Sequence: Synthetic oligonucleotide
tcctgtcgtctgcttgtccc

SEQ ID NO: 5529 - DNA, 19 bp, Artificial Sequence
  Description of Artificial Sequence: Synthetic oligonucleotide
cctttcgttcttccctccc

SEQ ID NO: 5530 - DNA, 20 bp, Artificial Sequence
  Description of Artificial Sequence: Synthetic oligonucleotide
tgagtcgttcccctcgtccc

SEQ ID NO: 5531 - DNA, 20 bp, Artificial Sequence
  Description of Artificial Sequence: Synthetic oligonucleotide
gcttttcgttctaccctccc

SEQ ID NO: 5532 - DNA, 18 bp, Artificial Sequence
  Description of Artificial Sequence: Synthetic oligonucleotide
attcactttttcttgccg

SEQ ID NO: 5533 - DNA, 20 bp, Artificial Sequence
  Description of Artificial Sequence: Synthetic oligonucleotide
ctttccttgctttccctccg

SEQ ID NO: 5534 - DNA, 20 bp, Artificial Sequence
  Description of Artificial Sequence: Synthetic oligonucleotide
ttttattatctccgtctccg

SEQ ID NO: 5535 - DNA, 20 bp, Artificial Sequence
  Description of Artificial Sequence: Synthetic oligonucleotide
tttgaagggtgatgtgtccc

SEQ ID NO: 5536 - DNA, 21 bp, Artificial Sequence
  Description of Artificial Sequence: Synthetic oligonucleotide
tacattctttttttctctccg

SEQ ID NO: 5537 - DNA, 20 bp, Artificial Sequence
  Description of Artificial Sequence: Synthetic oligonucleotide
ctattctatactcctttccg

SEQ ID NO: 5538 - DNA, 19 bp, Artificial Sequence
  Description of Artificial Sequence: Synthetic oligonucleotide
cacttctttctcttatccg

SEQ ID NO: 5539 - DNA, 20 bp, Artificial Sequence
  Description of Artificial Sequence: Synthetic oligonucleotide
tcctttcgttctgcctcccc

SEQ ID NO: 5540 - DNA, 20 bp, Artificial Sequence
  Description of Artificial Sequence: Synthetic oligonucleotide
tttttgttgtattggttccg

SEQ ID NO: 5541 - DNA, 20 bp, Artificial Sequence
  Description of Artificial Sequence: Synthetic oligonucleotide
ccatctactttcactttccg

SEQ ID NO: 5542 - DNA, 20 bp, Artificial Sequence
  Description of Artificial Sequence: Synthetic oligonucleotide
tttgttcttgtttttgtccg

SEQ ID NO: 5543 - DNA, 20 bp, Artificial Sequence
  Description of Artificial Sequence: Synthetic oligonucleotide
gttctttattccctctaccg

SEQ ID NO: 5544 - DNA, 20 bp, Artificial Sequence
  Description of Artificial Sequence: Synthetic oligonucleotide
gttattgtttgcttgtaccg

SEQ ID NO: 5545 - DNA, 20 bp, Artificial Sequence
  Description of Artificial Sequence: Synthetic oligonucleotide
tactcttttctcttaccccg

SEQ ID NO: 5546 - DNA, 19 bp, Artificial Sequence
  Description of Artificial Sequence: Synthetic oligonucleotide
tttgggttttcccgtgccg

SEQ ID NO: 5547 - DNA, 18 bp, Artificial Sequence
  Description of Artificial Sequence: Synthetic oligonucleotide
tttcttgttctctttccg

SEQ ID NO: 5548 - DNA, 20 bp, Artificial Sequence
  Description of Artificial Sequence: Synthetic oligonucleotide
tctatttgtgttcttttccc

SEQ ID NO: 5549 - DNA, 20 bp, Artificial Sequence
  Description of Artificial Sequence: Synthetic oligonucleotide
tccttttattcttctccccg

SEQ ID NO: 5550 - DNA, 20 bp, Artificial Sequence
  Description of Artificial Sequence: Synthetic oligonucleotide
tccatttctgtttttccccg

SEQ ID NO: 5551 - DNA, 18 bp, Artificial Sequence
  Description of Artificial Sequence: Synthetic oligonucleotide
tagtgttttttttgtgcc

SEQ ID NO: 5552 - DNA, 21 bp, Artificial Sequence
  Description of Artificial Sequence: Synthetic oligonucleotide
gttttcttgtttcttgttcct

SEQ ID NO: 5553 - DNA, 20 bp, Artificial Sequence
  Description of Artificial Sequence: Synthetic oligonucleotide
attctttttttttcccaccg

SEQ ID NO: 5554 - DNA, 20 bp, Artificial Sequence
  Description of Artificial Sequence: Synthetic oligonucleotide
tctctatatacatttctccg

SEQ ID NO: 5555 - DNA, 21 bp, Artificial Sequence
  Description of Artificial Sequence: Synthetic oligonucleotide
tttgttgcccctttttttccg

SEQ ID NO: 5556 - DNA, 20 bp, Artificial Sequence
  Description of Artificial Sequence: Synthetic oligonucleotide
ttttgctacttttacttccc

SEQ ID NO: 5557 - DNA, 20 bp, Artificial Sequence
  Description of Artificial Sequence: Synthetic oligonucleotide
tcttttattatgttcttctg

SEQ ID NO: 5558 - DNA, 20 bp, Artificial Sequence
  Description of Artificial Sequence: Synthetic oligonucleotide
accttttgttatttatcccg

SEQ ID NO: 5559 - DNA, 20 bp, Artificial Sequence
  Description of Artificial Sequence: Synthetic oligonucleotide
cgtattttttattctttgcc

SEQ ID NO: 5560 - DNA, 20 bp, Artificial Sequence
  Description of Artificial Sequence: Synthetic oligonucleotide
tcattctttttctcattgtg

SEQ ID NO: 5561 - DNA, 20 bp, Artificial Sequence
  Description of Artificial Sequence: Synthetic oligonucleotide
accgctgtttattttttccg

SEQ ID NO: 5562 - DNA, 20 bp, Artificial Sequence
  Description of Artificial Sequence: Synthetic oligonucleotide
attgtctctttattgtaccg

SEQ ID NO: 5563 - DNA, 20 bp, Artificial Sequence
  Description of Artificial Sequence: Synthetic oligonucleotide
atttttatattgcttccccg

SEQ ID NO: 5564 - DNA, 20 bp, Artificial Sequence
  Description of Artificial Sequence: Synthetic oligonucleotide
ttcgtgtcatttttcttccg

SEQ ID NO: 5565 - DNA, 21 bp, Artificial Sequence
  Description of Artificial Sequence: Synthetic oligonucleotide
ttttttcattttttcacgctg

SEQ ID NO: 5566 - DNA, 20 bp, Artificial Sequence
  Description of Artificial Sequence: Synthetic oligonucleotide
ccttttcgctcacttttccg

SEQ ID NO: 5567 - DNA, 20 bp, Artificial Sequence
  Description of Artificial Sequence: Synthetic oligonucleotide
gtttgtcattctttattccg

SEQ ID NO: 5568 - DNA, 20 bp, Artificial Sequence
  Description of Artificial Sequence: Synthetic oligonucleotide
ctttttgcctttattctccg

SEQ ID NO: 5569 - DNA, 20 bp, Artificial Sequence
  Description of Artificial Sequence: Synthetic oligonucleotide
tattgtattttttgttcccg

SEQ ID NO: 5570 - DNA, 19 bp, Artificial Sequence
  Description of Artificial Sequence: Synthetic oligonucleotide
tttcttttcattttttccg

SEQ ID NO: 5571 - DNA, 20 bp, Artificial Sequence
  Description of Artificial Sequence: Synthetic oligonucleotide
ccttttctcgctgttatccg

SEQ ID NO: 5572 - DNA, 20 bp, Artificial Sequence
  Description of Artificial Sequence: Synthetic oligonucleotide
tttctttcttcttgttcccg

SEQ ID NO: 5573 - DNA, 19 bp, Artificial Sequence
  Description of Artificial Sequence: Synthetic oligonucleotide
tctatttcctttctttccg

SEQ ID NO: 5574 - DNA, 20 bp, Artificial Sequence
  Description of Artificial Sequence: Synthetic oligonucleotide
tttgtttccattattgtccg

SEQ ID NO: 5575 - DNA, 20 bp, Artificial Sequence
  Description of Artificial Sequence: Synthetic oligonucleotide
ccctttatttatttctaccg

SEQ ID NO: 5576 - DNA, 20 bp, Artificial Sequence
  Description of Artificial Sequence: Synthetic oligonucleotide
tttctctttctctctttccg

SEQ ID NO: 5577 - DNA, 20 bp, Artificial Sequence
  Description of Artificial Sequence: Synthetic oligonucleotide
tctctttatttcttcttccg

SEQ ID NO: 5578 - DNA, 20 bp, Artificial Sequence
  Description of Artificial Sequence: Synthetic oligonucleotide
ttcattttcatttttctgcg

SEQ ID NO: 5579 - DNA, 21 bp, Artificial Sequence
  Description of Artificial Sequence: Synthetic oligonucleotide
ttatccttgtttttttatccc

SEQ ID NO: 5580 - DNA, 20 bp, Artificial Sequence
  Description of Artificial Sequence: Synthetic oligonucleotide
ttttctctcttcatcttccg

SEQ ID NO: 5581 - DNA, 20 bp, Artificial Sequence
  Description of Artificial Sequence: Synthetic oligonucleotide
tagtatgtttttgttttgtg

SEQ ID NO: 5582 - DNA, 20 bp, Artificial Sequence
  Description of Artificial Sequence: Synthetic oligonucleotide
tcttttcgctttacttaccg

SEQ ID NO: 5583 - DNA, 20 bp, Artificial Sequence
  Description of Artificial Sequence: Synthetic oligonucleotide
tatctatttacacttttccg

SEQ ID NO: 5584 - DNA, 20 bp, Artificial Sequence
  Description of Artificial Sequence: Synthetic oligonucleotide
tctttattctcactttcccg

SEQ ID NO: 5585 - DNA, 20 bp, Artificial Sequence
  Description of Artificial Sequence: Synthetic oligonucleotide
tacttttatactttttgcca

SEQ ID NO: 5586 - DNA, 20 bp, Artificial Sequence
  Description of Artificial Sequence: Synthetic oligonucleotide
atcttttttgttcttgtctg

SEQ ID NO: 5587 - DNA, 20 bp, Artificial Sequence
  Description of Artificial Sequence: Synthetic oligonucleotide
tactttttttttccactccg

SEQ ID NO: 5588 - DNA, 20 bp, Artificial Sequence
  Description of Artificial Sequence: Synthetic oligonucleotide
gttcttttcttccgctaccg

SEQ ID NO: 5589 - DNA, 20 bp, Artificial Sequence
  Description of Artificial Sequence: Synthetic oligonucleotide
atcttctttgttttttaccc

SEQ ID NO: 5590 - DNA, 21 bp, Artificial Sequence
  Description of Artificial Sequence: Synthetic oligonucleotide
tttttttgtctatcttttccg

SEQ ID NO: 5591 - DNA, 20 bp, Artificial Sequence
  Description of Artificial Sequence: Synthetic oligonucleotide
tttatttactttgtttcccc

SEQ ID NO: 5592 - DNA, 20 bp, Artificial Sequence
  Description of Artificial Sequence: Synthetic oligonucleotide
tttcactctctttttcgcgt

SEQ ID NO: 5593 - DNA, 19 bp, Artificial Sequence
  Description of Artificial Sequence: Synthetic oligonucleotide
tttctttctattctttccg

SEQ ID NO: 5594 - DNA, 20 bp, Artificial Sequence
  Description of Artificial Sequence: Synthetic oligonucleotide
ttattttatcacttttgcgc

SEQ ID NO: 5595 - DNA, 20 bp, Artificial Sequence
  Description of Artificial Sequence: Synthetic oligonucleotide
tcatttgctcatttcctccg

SEQ ID NO: 5596 - DNA, 20 bp, Artificial Sequence
  Description of Artificial Sequence: Synthetic oligonucleotide
ggttactttatcttttgccg

SEQ ID NO: 5597 - DNA, 20 bp, Artificial Sequence
  Description of Artificial Sequence: Synthetic oligonucleotide
actattgttttctctttccc

SEQ ID NO: 5598 - DNA, 20 bp, Artificial Sequence
  Description of Artificial Sequence: Synthetic oligonucleotide
tctttcaatcttctattccg

SEQ ID NO: 5599 - DNA, 20 bp, Artificial Sequence
  Description of Artificial Sequence: Synthetic oligonucleotide
acttctttcacttctttctg

SEQ ID NO: 5600 - DNA, 20 bp, Artificial Sequence
  Description of Artificial Sequence: Synthetic oligonucleotide
tttatttttcttgccccccg

SEQ ID NO: 5601 - DNA, 20 bp, Artificial Sequence
  Description of Artificial Sequence: Synthetic oligonucleotide
tctcttgtttatttttcccc

SEQ ID NO: 5602 - DNA, 20 bp, Artificial Sequence
  Description of Artificial Sequence: Synthetic oligonucleotide
tcttaacttcttttcctctg

SEQ ID NO: 5603 - DNA, 20 bp, Artificial Sequence
  Description of Artificial Sequence: Synthetic oligonucleotide
tcttttcaaccttttacccg

SEQ ID NO: 5604 - DNA, 20 bp, Artificial Sequence
  Description of Artificial Sequence: Synthetic oligonucleotide
ttttctattatcttcttgtg

SEQ ID NO: 5605 - DNA, 19 bp, Artificial Sequence
  Description of Artificial Sequence: Synthetic oligonucleotide
tttttgattcttgtttccg

SEQ ID NO: 5606 - DNA, 20 bp, Artificial Sequence
  Description of Artificial Sequence: Synthetic oligonucleotide
tctttattgtttttttaccc

SEQ ID NO: 5607 - DNA, 20 bp, Artificial Sequence
  Description of Artificial Sequence: Synthetic oligonucleotide
ttttctttatgttgttgttg

SEQ ID NO: 5608 - DNA, 20 bp, Artificial Sequence
  Description of Artificial Sequence: Synthetic oligonucleotide
cctttatttttatcttaccg

SEQ ID NO: 5609 - DNA, 20 bp, Artificial Sequence
  Description of Artificial Sequence: Synthetic oligonucleotide
ttgtttttctattgtttgcg

SEQ ID NO: 5610 - DNA, 21 bp, Artificial Sequence
  Description of Artificial Sequence: Synthetic oligonucleotide
tttctcagctttttttttccg

SEQ ID NO: 5611 - DNA, 20 bp, Artificial Sequence
  Description of Artificial Sequence: Synthetic oligonucleotide
ctttttatcttacttttccc

SEQ ID NO: 5612 - DNA, 20 bp, Artificial Sequence
  Description of Artificial Sequence: Synthetic oligonucleotide
tcctgtcggctgttggtccc

SEQ ID NO: 5613 - DNA, 22 bp, Artificial Sequence
  Description of Artificial Sequence: Synthetic oligonucleotide
gtcctgtcgtctgtttcgtccc

SEQ ID NO: 5614 - DNA, 20 bp, Artificial Sequence
  Description of Artificial Sequence: Synthetic oligonucleotide
tcttgtcgtctttgcgtccc

SEQ ID NO: 5615 - DNA, 20 bp, Artificial Sequence
  Description of Artificial Sequence: Synthetic oligonucleotide
tcctgtcgtctttgcgcccc

SEQ ID NO: 5616 - DNA, 20 bp, Artificial Sequence
  Description of Artificial Sequence: Synthetic oligonucleotide
tcctgtcgtctgttcggttc

SEQ ID NO: 5617 - DNA, 20 bp, Artificial Sequence
  Description of Artificial Sequence: Synthetic oligonucleotide
cgattcctctgtttcgtccc

SEQ ID NO: 5618 - DNA, 20 bp, Artificial Sequence
  Description of Artificial Sequence: Synthetic oligonucleotide
tgagtcgctcccttcgtccc

SEQ ID NO: 5619 - DNA, 20 bp, Artificial Sequence
  Description of Artificial Sequence: Synthetic oligonucleotide
cgcttttctttttctcgccc

SEQ ID NO: 5620 - DNA, 20 bp, Artificial Sequence
  Description of Artificial Sequence: Synthetic oligonucleotide
tttgggattagggtgttccg

SEQ ID NO: 5621 - DNA, 19 bp, Artificial Sequence
  Description of Artificial Sequence: Synthetic oligonucleotide
tttgggagtaggtgttccg

SEQ ID NO: 5622 - DNA, 20 bp, Artificial Sequence
  Description of Artificial Sequence: Synthetic oligonucleotide
tttctttaatttccccgccg

SEQ ID NO: 5623 - DNA, 20 bp, Artificial Sequence
  Description of Artificial Sequence: Synthetic oligonucleotide
tttggtgtaggggggttccg

SEQ ID NO: 5624 - DNA, 20 bp, Artificial Sequence
  Description of Artificial Sequence: Synthetic oligonucleotide
tttattccactttctctccg

SEQ ID NO: 5625 - DNA, 20 bp, Artificial Sequence
  Description of Artificial Sequence: Synthetic oligonucleotide
tgtttattttgttcttgccg

SEQ ID NO: 5626 - DNA, 20 bp, Artificial Sequence
  Description of Artificial Sequence: Synthetic oligonucleotide
gttcttatttcctctgtccg

SEQ ID NO: 5627 - DNA, 20 bp, Artificial Sequence
  Description of Artificial Sequence: Synthetic oligonucleotide
aatctttgtatttttcgccg

SEQ ID NO: 5628 - DNA, 20 bp, Artificial Sequence
  Description of Artificial Sequence: Synthetic oligonucleotide
ttattttatctctggctccg

SEQ ID NO: 5629 - DNA, 20 bp, Artificial Sequence
  Description of Artificial Sequence: Synthetic oligonucleotide
ccgtttcatcttttttaccg

SEQ ID NO: 5630 - DNA, 20 bp, Artificial Sequence
  Description of Artificial Sequence: Synthetic oligonucleotide
tctcgctttcttttactccg

SEQ ID NO: 5631 - DNA, 20 bp, Artificial Sequence
  Description of Artificial Sequence: Synthetic oligonucleotide
tctttcatttctttccccgc

SEQ ID NO: 5632 - DNA, 19 bp, Artificial Sequence
  Description of Artificial Sequence: Synthetic oligonucleotide
cttttattgtttccttccg

SEQ ID NO: 5633 - DNA, 20 bp, Artificial Sequence
  Description of Artificial Sequence: Synthetic oligonucleotide
tcattttgttatcttttgtg

SEQ ID NO: 5634 - DNA, 20 bp, Artificial Sequence
  Description of Artificial Sequence: Synthetic oligonucleotide
tcgctttcattcattttccg

SEQ ID NO: 5635 - DNA, 20 bp, Artificial Sequence
  Description of Artificial Sequence: Synthetic oligonucleotide
gctctttcacctttcttccg

SEQ ID NO: 5636 - DNA, 20 bp, Artificial Sequence
  Description of Artificial Sequence: Synthetic oligonucleotide
atatatcattcttttcaccc

SEQ ID NO: 5637 - DNA, 20 bp, Artificial Sequence
  Description of Artificial Sequence: Synthetic oligonucleotide
cccttttatcctgttttccg

SEQ ID NO: 5638 - DNA, 20 bp, Artificial Sequence
  Description of Artificial Sequence: Synthetic oligonucleotide
aacactttctttctctaccg

SEQ ID NO: 5639 - DNA, 20 bp, Artificial Sequence
  Description of Artificial Sequence: Synthetic oligonucleotide
ataactttttactctcaccg

SEQ ID NO: 5640 - DNA, 20 bp, Artificial Sequence
  Description of Artificial Sequence: Synthetic oligonucleotide
ttttctttcaacctttgccg

SEQ ID NO: 5641 - DNA, 20 bp, Artificial Sequence
  Description of Artificial Sequence: Synthetic oligonucleotide
tctttttgtcacttctccgc

SEQ ID NO: 5642 - DNA, 20 bp, Artificial Sequence
  Description of Artificial Sequence: Synthetic oligonucleotide
cttatcttcattttttaccg

SEQ ID NO: 5643 - DNA, 21 bp, Artificial Sequence
  Description of Artificial Sequence: Synthetic oligonucleotide
actctgttttttttccttccg

SEQ ID NO: 5644 - DNA, 20 bp, Artificial Sequence
  Description of Artificial Sequence: Synthetic oligonucleotide
gttttgtatctttgttaccg

SEQ ID NO: 5645 - DNA, 20 bp, Artificial Sequence
  Description of Artificial Sequence: Synthetic oligonucleotide
tctattttctttctctaccc

SEQ ID NO: 5646 - DNA, 20 bp, Artificial Sequence
  Description of Artificial Sequence: Synthetic oligonucleotide
tttccttatattcttctgtg

SEQ ID NO: 5647 - DNA, 20 bp, Artificial Sequence
  Description of Artificial Sequence: Synthetic oligonucleotide
gttctttattctattccccg

SEQ ID NO: 5648 - DNA, 20 bp, Artificial Sequence
  Description of Artificial Sequence: Synthetic oligonucleotide
tgttttctccgttcttgccg

SEQ ID NO: 5649 - DNA, 20 bp, Artificial Sequence
  Description of Artificial Sequence: Synthetic oligonucleotide
attccttactatctcttccg

SEQ ID NO: 5650 - DNA, 19 bp, Artificial Sequence
  Description of Artificial Sequence: Synthetic oligonucleotide
tcatttctctccttttccg

SEQ ID NO: 5651 - DNA, 20 bp, Artificial Sequence
  Description of Artificial Sequence: Synthetic oligonucleotide
ccttgtctttttttcttccg

SEQ ID NO: 5652 - DNA, 21 bp, Artificial Sequence
  Description of Artificial Sequence: Synthetic oligonucleotide
tttatttctttccactttccg

SEQ ID NO: 5653 - DNA, 20 bp, Artificial Sequence
  Description of Artificial Sequence: Synthetic oligonucleotide
ccttttagttccttttaccg

SEQ ID NO: 5654 - DNA, 20 bp, Artificial Sequence
  Description of Artificial Sequence: Synthetic oligonucleotide
actttattctctcacttccg

SEQ ID NO: 5655 - DNA, 20 bp, Artificial Sequence
  Description of Artificial Sequence: Synthetic oligonucleotide
attacattttcatttcaccc

SEQ ID NO: 5656 - DNA, 20 bp, Artificial Sequence
  Description of Artificial Sequence: Synthetic oligonucleotide
tttctcaatattttcgcccg

SEQ ID NO: 5657 - DNA, 20 bp, Artificial Sequence
  Description of Artificial Sequence: Synthetic oligonucleotide
tttcacttttctttttccca

SEQ ID NO: 5658 - DNA, 20 bp, Artificial Sequence
  Description of Artificial Sequence: Synthetic oligonucleotide
acattccttacttttttccg

SEQ ID NO: 5659 - DNA, 21 bp, Artificial Sequence
  Description of Artificial Sequence: Synthetic oligonucleotide
attttgttttcgtttttgcca

SEQ ID NO: 5660 - DNA, 20 bp, Artificial Sequence
  Description of Artificial Sequence: Synthetic oligonucleotide
ttttaactcttttctctctg

SEQ ID NO: 5661 - DNA, 20 bp, Artificial Sequence
  Description of Artificial Sequence: Synthetic oligonucleotide
tattcttttgtttcttttcg

SEQ ID NO: 5662 - DNA, 20 bp, Artificial Sequence
  Description of Artificial Sequence: Synthetic oligonucleotide
tttattcttattttgctcca

SEQ ID NO: 5663 - DNA, 20 bp, Artificial Sequence
  Description of Artificial Sequence: Synthetic oligonucleotide
tttccattctttcatatccg

SEQ ID NO: 5664 - DNA, 20 bp, Artificial Sequence
  Description of Artificial Sequence: Synthetic oligonucleotide
tatattctgttttccttctg

SEQ ID NO: 5665 - DNA, 20 bp, Artificial Sequence
  Description of Artificial Sequence: Synthetic oligonucleotide
ccttttttatcccctttccg

SEQ ID NO: 5666 - DNA, 20 bp, Artificial Sequence
  Description of Artificial Sequence: Synthetic oligonucleotide
cttttttagtccttttgccg

SEQ ID NO: 5667 - DNA, 20 bp, Artificial Sequence
  Description of Artificial Sequence: Synthetic oligonucleotide
catttatctctcttttcccg

SEQ ID NO: 5668 - DNA, 20 bp, Artificial Sequence
  Description of Artificial Sequence: Synthetic oligonucleotide
attcttaattgtttttaccg

SEQ ID NO: 5669 - DNA, 20 bp, Artificial Sequence
  Description of Artificial Sequence: Synthetic oligonucleotide
gatcttttattttcacaccc

SEQ ID NO: 5670 - DNA, 21 bp, Artificial Sequence
  Description of Artificial Sequence: Synthetic oligonucleotide
ctttcattttttttctctccg

SEQ ID NO: 5671 - DNA, 19 bp, Artificial Sequence
  Description of Artificial Sequence: Synthetic oligonucleotide
ttcttcttacttccttccg

SEQ ID NO: 5672 - DNA, 20 bp, Artificial Sequence
  Description of Artificial Sequence: Synthetic oligonucleotide
cttttctactatttaccccg

SEQ ID NO: 5673 - DNA, 20 bp, Artificial Sequence
  Description of Artificial Sequence: Synthetic oligonucleotide
ttctcattcgttactttccg

SEQ ID NO: 5674 - DNA, 18 bp, Artificial Sequence
  Description of Artificial Sequence: Synthetic oligonucleotide
cttttctttctctttccg

SEQ ID NO: 5675 - DNA, 20 bp, Artificial Sequence
  Description of Artificial Sequence: Synthetic oligonucleotide
actttgtctttgtttttgcc

SEQ ID NO: 5676 - DNA, 20 bp, Artificial Sequence
  Description of Artificial Sequence: Synthetic oligonucleotide
gtttttcaattttcattccg

SEQ ID NO: 5677 - DNA, 20 bp, Artificial Sequence
  Description of Artificial Sequence: Synthetic oligonucleotide
tttttgttttattgcctgcg

SEQ ID NO: 5678 - DNA, 20 bp, Artificial Sequence
  Description of Artificial Sequence: Synthetic oligonucleotide
tttcacttttctcttcgcca

SEQ ID NO: 5679 - DNA, 20 bp, Artificial Sequence
  Description of Artificial Sequence: Synthetic oligonucleotide
cgtttatattttccttcccg

SEQ ID NO: 5680 - DNA, 20 bp, Artificial Sequence
  Description of Artificial Sequence: Synthetic oligonucleotide
tcatttcttagttcttcccg

SEQ ID NO: 5681 - DNA, 20 bp, Artificial Sequence
  Description of Artificial Sequence: Synthetic oligonucleotide
ttttcttttaacactttctg

SEQ ID NO: 5682 - DNA, 20 bp, Artificial Sequence
  Description of Artificial Sequence: Synthetic oligonucleotide
atttatatcactcttttgcc

SEQ ID NO: 5683 - DNA, 20 bp, Artificial Sequence
  Description of Artificial Sequence: Synthetic oligonucleotide
atcttcacaatttttcgccg

SEQ ID NO: 5684 - DNA, 20 bp, Artificial Sequence
  Description of Artificial Sequence: Synthetic oligonucleotide
ttttctatttttcccctatg

SEQ ID NO: 5685 - DNA, 20 bp, Artificial Sequence
  Description of Artificial Sequence: Synthetic oligonucleotide
tcctttgtttctttaccccg

SEQ ID NO: 5686 - DNA, 20 bp, Artificial Sequence
  Description of Artificial Sequence: Synthetic oligonucleotide
ttttatttctatgtgttccc

SEQ ID NO: 5687 - DNA, 20 bp, Artificial Sequence
  Description of Artificial Sequence: Synthetic oligonucleotide
tttcttcctgtttttccccg

SEQ ID NO: 5688 - DNA, 20 bp, Artificial Sequence
  Description of Artificial Sequence: Synthetic oligonucleotide
tttgctcttttcttattccc

SEQ ID NO: 5689 - DNA, 20 bp, Artificial Sequence
  Description of Artificial Sequence: Synthetic oligonucleotide
cttactgttttttctttccg

SEQ ID NO: 5690 - DNA, 20 bp, Artificial Sequence
  Description of Artificial Sequence: Synthetic oligonucleotide
tttttattttgttacatgtg

SEQ ID NO: 5691 - DNA, 20 bp, Artificial Sequence
  Description of Artificial Sequence: Synthetic oligonucleotide
tcttattttgtattttcccg

SEQ ID NO: 5692 - DNA, 20 bp, Artificial Sequence
  Description of Artificial Sequence: Synthetic oligonucleotide
aattattttctttcacactg

SEQ ID NO: 5693 - DNA, 20 bp, Artificial Sequence
  Description of Artificial Sequence: Synthetic oligonucleotide
tttattccatttattttccg

SEQ ID NO: 5694 - DNA, 21 bp, Artificial Sequence
  Description of Artificial Sequence: Synthetic oligonucleotide
tttatttttttcccgtttgtg

SEQ ID NO: 5695 - DNA, 20 bp, Artificial Sequence
  Description of Artificial Sequence: Synthetic oligonucleotide
tttttacttgatcctttctg

SEQ ID NO: 5696 - DNA, 20 bp, Artificial Sequence
  Description of Artificial Sequence: Synthetic oligonucleotide
attttcttttttttctgccg

SEQ ID NO: 5697 - DNA, 20 bp, Artificial Sequence
  Description of Artificial Sequence: Synthetic oligonucleotide
atattcgttgtttcttcccg

SEQ ID NO: 5698 - DNA, 19 bp, Artificial Sequence
  Description of Artificial Sequence: Synthetic oligonucleotide
tttctcagctttttttccg

SEQ ID NO: 5699 - DNA, 20 bp, Artificial Sequence
  Description of Artificial Sequence: Synthetic oligonucleotide
ttctaattttattccctccg

SEQ ID NO: 5700 - DNA, 21 bp, Artificial Sequence
  Description of Artificial Sequence: Synthetic oligonucleotide
ttatttttgtttttttgcgtg

SEQ ID NO: 5701 - DNA, 20 bp, Artificial Sequence
  Description of Artificial Sequence: Synthetic oligonucleotide
cctttttctttctttacccg

SEQ ID NO: 5702 - DNA, 22 bp, Artificial Sequence
  Description of Artificial Sequence: Synthetic oligonucleotide
attccacttttttttttcaccg

SEQ ID NO: 5703 - DNA, 21 bp, Artificial Sequence
  Description of Artificial Sequence: Synthetic oligonucleotide
gttttgtttttttcctttccg

SEQ ID NO: 5704 - DNA, 20 bp, Artificial Sequence
  Description of Artificial Sequence: Synthetic oligonucleotide
gtttttttatcacttttccc

SEQ ID NO: 5705 - DNA, 21 bp, Artificial Sequence
  Description of Artificial Sequence: Synthetic oligonucleotide
gatttgttttttgttttgtac

SEQ ID NO: 5706 - DNA, 20 bp, Artificial Sequence
  Description of Artificial Sequence: Synthetic oligonucleotide
ttcttattttcttttctgtg

SEQ ID NO: 5707 - DNA, 20 bp, Artificial Sequence
  Description of Artificial Sequence: Synthetic oligonucleotide
actgttctctatttttaccg

SEQ ID NO: 5708 - DNA, 21 bp, Artificial Sequence
  Description of Artificial Sequence: Synthetic oligonucleotide
tattttctacctttttttccg

SEQ ID NO: 5709 - DNA, 19 bp, Artificial Sequence
  Description of Artificial Sequence: Synthetic oligonucleotide
attttattgttttttaccg

SEQ ID NO: 5710 - DNA, 19 bp, Artificial Sequence
  Description of Artificial Sequence: Synthetic oligonucleotide
ttctttattttttcctccg

SEQ ID NO: 5711 - DNA, 21 bp, Artificial Sequence
  Description of Artificial Sequence: Synthetic oligonucleotide
attctctttcttttttcaccg

SEQ ID NO: 5712 - DNA, 18 bp, Artificial Sequence
  Description of Artificial Sequence: Synthetic oligonucleotide
tttcatcttttttttccg

SEQ ID NO: 5713 - DNA, 20 bp, Artificial Sequence
  Description of Artificial Sequence: Synthetic oligonucleotide
ctctttttatgttttttccc

SEQ ID NO: 5714 - DNA, 21 bp, Artificial Sequence
  Description of Artificial Sequence: Synthetic oligonucleotide
ttttcattcttttttttcccc

SEQ ID NO: 5715 - DNA, 20 bp, Artificial Sequence
  Description of Artificial Sequence: Synthetic oligonucleotide
cttcttttccattatttccg

SEQ ID NO: 5716 - DNA, 20 bp, Artificial Sequence
  Description of Artificial Sequence: Synthetic oligonucleotide
tgagtcgttcctttcgtccc

SEQ ID NO: 5717 - DNA, 20 bp, Artificial Sequence
  Description of Artificial Sequence: Synthetic oligonucleotide
tgagtcgtttccttcgtccc

SEQ ID NO: 5718 - DNA, 20 bp, Artificial Sequence
  Description of Artificial Sequence: Synthetic oligonucleotide
tcctgtcgtccttgcgtccc

SEQ ID NO: 5719 - DNA, 20 bp, Artificial Sequence
  Description of Artificial Sequence: Synthetic oligonucleotide
tttggggttttcccgtgcca

SEQ ID NO: 5720 - DNA, 19 bp, Artificial Sequence
  Description of Artificial Sequence: Synthetic oligonucleotide
attcacttctttcttgccg

SEQ ID NO: 5721 - DNA, 20 bp, Artificial Sequence
  Description of Artificial Sequence: Synthetic oligonucleotide
tttaattcattcccgttccg

SEQ ID NO: 5722 - DNA, 19 bp, Artificial Sequence
  Description of Artificial Sequence: Synthetic oligonucleotide
ttccctgttattttctccg

SEQ ID NO: 5723 - DNA, 20 bp, Artificial Sequence
  Description of Artificial Sequence: Synthetic oligonucleotide
cttttccttttccctatccg

SEQ ID NO: 5724 - DNA, 20 bp, Artificial Sequence
  Description of Artificial Sequence: Synthetic oligonucleotide
gtctcctggcttatcgtccc

SEQ ID NO: 5725 - DNA, 19 bp, Artificial Sequence
  Description of Artificial Sequence: Synthetic oligonucleotide
attcttgccttttttgccg

SEQ ID NO: 5726 - DNA, 20 bp, Artificial Sequence
  Description of Artificial Sequence: Synthetic oligonucleotide
tttccttgtctccatttccg

SEQ ID NO: 5727 - DNA, 20 bp, Artificial Sequence
  Description of Artificial Sequence: Synthetic oligonucleotide
gtttttatgcttcctctccg

SEQ ID NO: 5728 - DNA, 20 bp, Artificial Sequence
  Description of Artificial Sequence: Synthetic oligonucleotide
ctttatttttgtttttgccc

SEQ ID NO: 5729 - DNA, 22 bp, Artificial Sequence
  Description of Artificial Sequence: Synthetic oligonucleotide
tcttgttttttttctttgccgc

SEQ ID NO: 5730 - DNA, 20 bp, Artificial Sequence
  Description of Artificial Sequence: Synthetic oligonucleotide
gattcttgttactttcaccc

SEQ ID NO: 5731 - DNA, 20 bp, Artificial Sequence
  Description of Artificial Sequence: Synthetic oligonucleotide
tcttttcgaacttgtttccg

SEQ ID NO: 5732 - DNA, 20 bp, Artificial Sequence
  Description of Artificial Sequence: Synthetic oligonucleotide
ctttctcttccgttgttccg

SEQ ID NO: 5733 - DNA, 20 bp, Artificial Sequence
  Description of Artificial Sequence: Synthetic oligonucleotide
ttttattcctttccgctccg

SEQ ID NO: 5734 - DNA, 20 bp, Artificial Sequence
  Description of Artificial Sequence: Synthetic oligonucleotide
tcttattcgatttccctccg

SEQ ID NO: 5735 - DNA, 20 bp, Artificial Sequence
  Description of Artificial Sequence: Synthetic oligonucleotide
gtttattccctgttgttccg

SEQ ID NO: 5736 - DNA, 20 bp, Artificial Sequence
  Description of Artificial Sequence: Synthetic oligonucleotide
ccttttacctcacttatccg

SEQ ID NO: 5737 - DNA, 20 bp, Artificial Sequence
  Description of Artificial Sequence: Synthetic oligonucleotide
tttttatacatgttcctccg

SEQ ID NO: 5738 - DNA, 20 bp, Artificial Sequence
  Description of Artificial Sequence: Synthetic oligonucleotide
cttttattctctcttccccg

SEQ ID NO: 5739 - DNA, 20 bp, Artificial Sequence
  Description of Artificial Sequence: Synthetic oligonucleotide
actttgttacctctttaccg

SEQ ID NO: 5740 - DNA, 20 bp, Artificial Sequence
  Description of Artificial Sequence: Synthetic oligonucleotide
ttacttttctaacttctccg

SEQ ID NO: 5741 - DNA, 20 bp, Artificial Sequence
  Description of Artificial Sequence: Synthetic oligonucleotide
attctcctgcttttcttccg

SEQ ID NO: 5742 - DNA, 20 bp, Artificial Sequence
  Description of Artificial Sequence: Synthetic oligonucleotide
actttcatactttttcaccg

SEQ ID NO: 5743 - DNA, 20 bp, Artificial Sequence
  Description of Artificial Sequence: Synthetic oligonucleotide
tattcttctttcgctttgtg

SEQ ID NO: 5744 - DNA, 21 bp, Artificial Sequence
  Description of Artificial Sequence: Synthetic oligonucleotide
cttcttgtgttttttttgctg

SEQ ID NO: 5745 - DNA, 21 bp, Artificial Sequence
  Description of Artificial Sequence: Synthetic oligonucleotide
tttgaactctttttttttccg

SEQ ID NO: 5746 - DNA, 20 bp, Artificial Sequence
  Description of Artificial Sequence: Synthetic oligonucleotide
ccatgttttccttttatccg

SEQ ID NO: 5747 - DNA, 22 bp, Artificial Sequence
  Description of Artificial Sequence: Synthetic oligonucleotide
aactactttttttctctctccg

SEQ ID NO: 5748 - DNA, 22 bp, Artificial Sequence
  Description of Artificial Sequence: Synthetic oligonucleotide
tttttcactttttttcgccccg

SEQ ID NO: 5749 - DNA, 20 bp, Artificial Sequence
  Description of Artificial Sequence: Synthetic oligonucleotide
atttcttttcctttttgccg

SEQ ID NO: 5750 - DNA, 22 bp, Artificial Sequence
  Description of Artificial Sequence: Synthetic oligonucleotide
tcttttttttttgtttcccccg

SEQ ID NO: 5751 - DNA, 20 bp, Artificial Sequence
  Description of Artificial Sequence: Synthetic oligonucleotide
gattttcttgccttttaccg

SEQ ID NO: 5752 - DNA, 20 bp, Artificial Sequence
  Description of Artificial Sequence: Synthetic oligonucleotide
tttttcctatctccttgccg

SEQ ID NO: 5753 - DNA, 20 bp, Artificial Sequence
  Description of Artificial Sequence: Synthetic oligonucleotide
tttggtagtagggtgttccg

SEQ ID NO: 5754 - DNA, 20 bp, Artificial Sequence
  Description of Artificial Sequence: Synthetic oligonucleotide
gtttcctcttctttttcccc

SEQ ID NO: 5755 - DNA, 21 bp, Artificial Sequence
  Description of Artificial Sequence: Synthetic oligonucleotide
gatatttacttttttttggcc

SEQ ID NO: 5756 - DNA, 20 bp, Artificial Sequence
  Description of Artificial Sequence: Synthetic oligonucleotide
ctcatttacacttatttccg

SEQ ID NO: 5757 - DNA, 18 bp, Artificial Sequence
  Description of Artificial Sequence: Synthetic oligonucleotide
cttgtgtttttttttgcc

SEQ ID NO: 5758 - DNA, 20 bp, Artificial Sequence
  Description of Artificial Sequence: Synthetic oligonucleotide
ttttattcttttccgttccg

SEQ ID NO: 5759 - DNA, 20 bp, Artificial Sequence
  Description of Artificial Sequence: Synthetic oligonucleotide
ttctttgtttattccccctg

SEQ ID NO: 5760 - DNA, 20 bp, Artificial Sequence
  Description of Artificial Sequence: Synthetic oligonucleotide
cttttctttttcctcttctg

SEQ ID NO: 5761 - DNA, 20 bp, Artificial Sequence
  Description of Artificial Sequence: Synthetic oligonucleotide
tttttttctacttttcaccg

SEQ ID NO: 5762 - DNA, 20 bp, Artificial Sequence
  Description of Artificial Sequence: Synthetic oligonucleotide
tttctttattgtttttgtgc

SEQ ID NO: 5763 - DNA, 21 bp, Artificial Sequence
  Description of Artificial Sequence: Synthetic oligonucleotide
tttttttttctgttttccccg

SEQ ID NO: 5764 - DNA, 20 bp, Artificial Sequence
  Description of Artificial Sequence: Synthetic oligonucleotide
actttctcttttgtattccg

SEQ ID NO: 5765 - DNA, 20 bp, Artificial Sequence
  Description of Artificial Sequence: Synthetic oligonucleotide
tattttttcaggtttccccg

SEQ ID NO: 5766 - DNA, 20 bp, Artificial Sequence
  Description of Artificial Sequence: Synthetic oligonucleotide
ttcactttttcttttttgcg

SEQ ID NO: 5767 - DNA, 21 bp, Artificial Sequence
  Description of Artificial Sequence: Synthetic oligonucleotide
attgcgtactttttttttccg

SEQ ID NO: 5768 - DNA, 22 bp, Artificial Sequence
  Description of Artificial Sequence: Synthetic oligonucleotide
atttgctttttttttgattccg

SEQ ID NO: 5769 - DNA, 20 bp, Artificial Sequence
  Description of Artificial Sequence: Synthetic oligonucleotide
gtttctacgacttttttccg

SEQ ID NO: 5770 - DNA, 20 bp, Artificial Sequence
  Description of Artificial Sequence: Synthetic oligonucleotide
tcacttttttttctaccccg

SEQ ID NO: 5771 - DNA, 20 bp, Artificial Sequence
  Description of Artificial Sequence: Synthetic oligonucleotide
attcttctctacttacaccg

SEQ ID NO: 5772 - DNA, 20 bp, Artificial Sequence
  Description of Artificial Sequence: Synthetic oligonucleotide
tatcttttaacttttgcccg

SEQ ID NO: 5773 - DNA, 19 bp, Artificial Sequence
  Description of Artificial Sequence: Synthetic oligonucleotide
tgttttatttgtttttccc

SEQ ID NO: 5774 - DNA, 20 bp, Artificial Sequence
  Description of Artificial Sequence: Synthetic oligonucleotide
tatcttgcttctcttttgcc

SEQ ID NO: 5775 - DNA, 20 bp, Artificial Sequence
  Description of Artificial Sequence: Synthetic oligonucleotide
actttactttactctttccc

SEQ ID NO: 5776 - DNA, 21 bp, Artificial Sequence
  Description of Artificial Sequence: Synthetic oligonucleotide
gttccatttttttttccaccg

SEQ ID NO: 5777 - DNA, 20 bp, Artificial Sequence
  Description of Artificial Sequence: Synthetic oligonucleotide
actgcttttacttttttccc

SEQ ID NO: 5778 - DNA, 21 bp, Artificial Sequence
  Description of Artificial Sequence: Synthetic oligonucleotide
atcttttcgctttttttaccg

SEQ ID NO: 5779 - DNA, 22 bp, Artificial Sequence
  Description of Artificial Sequence: Synthetic oligonucleotide
tactttttttttttccactccg

SEQ ID NO: 5780 - DNA, 22 bp, Artificial Sequence
  Description of Artificial Sequence: Synthetic oligonucleotide
attttcatttttttttccgccg

SEQ ID NO: 5781 - DNA, 21 bp, Artificial Sequence
  Description of Artificial Sequence: Synthetic oligonucleotide
attttgctttttttactaccg

SEQ ID NO: 5782 - DNA, 20 bp, Artificial Sequence
  Description of Artificial Sequence: Synthetic oligonucleotide
ctttttactacttttctccg

SEQ ID NO: 5783 - DNA, 21 bp, Artificial Sequence
  Description of Artificial Sequence: Synthetic oligonucleotide
tctatgtttattttgtctccg

SEQ ID NO: 5784 - DNA, 21 bp, Artificial Sequence
  Description of Artificial Sequence: Synthetic oligonucleotide
attttttcctgttttttgccg

SEQ ID NO: 5785 - DNA, 20 bp, Artificial Sequence
  Description of Artificial Sequence: Synthetic oligonucleotide
ttctttattactatcttccg

SEQ ID NO: 5786 - DNA, 19 bp, Artificial Sequence
  Description of Artificial Sequence: Synthetic oligonucleotide
ttacctttttcttttcccg

SEQ ID NO: 5787 - DNA, 20 bp, Artificial Sequence
  Description of Artificial Sequence: Synthetic oligonucleotide
tttttatttttgtttgtcgg

SEQ ID NO: 5788 - DNA, 20 bp, Artificial Sequence
  Description of Artificial Sequence: Synthetic oligonucleotide
atttttcttcatctttaccg

SEQ ID NO: 5789 - DNA, 20 bp, Artificial Sequence
  Description of Artificial Sequence: Synthetic oligonucleotide
tactttgttcttcttctctg

SEQ ID NO: 5790 - DNA, 21 bp, Artificial Sequence
  Description of Artificial Sequence: Synthetic oligonucleotide
tctttttctaccttttttccg

SEQ ID NO: 5791 - DNA, 20 bp, Artificial Sequence
  Description of Artificial Sequence: Synthetic oligonucleotide
cgtttttcacttactttccg

SEQ ID NO: 5792 - DNA, 20 bp, Artificial Sequence
  Description of Artificial Sequence: Synthetic oligonucleotide
ctttacttatttcatttctg

SEQ ID NO: 5793 - DNA, 22 bp, Artificial Sequence
  Description of Artificial Sequence: Synthetic oligonucleotide
ctttttttttcctttttttccg

SEQ ID NO: 5794 - DNA, 20 bp, Artificial Sequence
  Description of Artificial Sequence: Synthetic oligonucleotide
catttatttttttccttggc

SEQ ID NO: 5795 - DNA, 21 bp, Artificial Sequence
  Description of Artificial Sequence: Synthetic oligonucleotide
tttctttttcacttccctatg

SEQ ID NO: 5796 - DNA, 20 bp, Artificial Sequence
  Description of Artificial Sequence: Synthetic oligonucleotide
tcatttctttcttattcccc

SEQ ID NO: 5797 - DNA, 21 bp, Artificial Sequence
  Description of Artificial Sequence: Synthetic oligonucleotide
tttggttttaattttttcccg

SEQ ID NO: 5798 - DNA, 20 bp, Artificial Sequence
  Description of Artificial Sequence: Synthetic oligonucleotide
catttcttttttcttttccg

SEQ ID NO: 5799 - DNA, 20 bp, Artificial Sequence
  Description of Artificial Sequence: Synthetic oligonucleotide
tctctttgtacttacttccg

SEQ ID NO: 5800 - DNA, 22 bp, Artificial Sequence
  Description of Artificial Sequence: Synthetic oligonucleotide
tacttctttttttttctctccg

SEQ ID NO: 5801 - DNA, 20 bp, Artificial Sequence
  Description of Artificial Sequence: Synthetic oligonucleotide
tattctttattattcttgtc

SEQ ID NO: 5802 - DNA, 22 bp, Artificial Sequence
  Description of Artificial Sequence: Synthetic oligonucleotide
atctacacttttttttttcccg

SEQ ID NO: 5803 - DNA, 19 bp, Artificial Sequence
  Description of Artificial Sequence: Synthetic oligonucleotide
ttttatctttctttttccc

SEQ ID NO: 5804 - DNA, 19 bp, Artificial Sequence
  Description of Artificial Sequence: Synthetic oligonucleotide
tcttttaactttttctccg

SEQ ID NO: 5805 - DNA, 19 bp, Artificial Sequence
  Description of Artificial Sequence: Synthetic oligonucleotide
tccttgtgtcttgcgtccc

SEQ ID NO: 5806 - DNA, 20 bp, Artificial Sequence
  Description of Artificial Sequence: Synthetic oligonucleotide
tttggggtttttccgtgccc

SEQ ID NO: 5807 - DNA, 20 bp, Artificial Sequence
  Description of Artificial Sequence: Synthetic oligonucleotide
tcctgtcgtctctgcgtccc

SEQ ID NO: 5808 - DNA, 21 bp, Artificial Sequence
  Description of Artificial Sequence: Synthetic oligonucleotide
ttcctgtcgtctgttcgtccc

SEQ ID NO: 5809 - DNA, 20 bp, Artificial Sequence
  Description of Artificial Sequence: Synthetic oligonucleotide
tcattgtttttgtgtggccc

SEQ ID NO: 5810 - DNA, 20 bp, Artificial Sequence
  Description of Artificial Sequence: Synthetic oligonucleotide
ttcgaagggtgttgggtccg

SEQ ID NO: 5811 - DNA, 21 bp, Artificial Sequence
  Description of Artificial Sequence: Synthetic oligonucleotide
tttagcttttttttccctccg

SEQ ID NO: 5812 - DNA, 20 bp, Artificial Sequence
  Description of Artificial Sequence: Synthetic oligonucleotide
tcactttgcctttctttccg

SEQ ID NO: 5813 - DNA, 20 bp, Artificial Sequence
  Description of Artificial Sequence: Synthetic oligonucleotide
cttcttgcttttttcccccg

SEQ ID NO: 5814 - DNA, 22 bp, Artificial Sequence
  Description of Artificial Sequence: Synthetic oligonucleotide
tttcactcttttttttccccgc

SEQ ID NO: 5815 - DNA, 20 bp, Artificial Sequence
  Description of Artificial Sequence: Synthetic oligonucleotide
tctgtattcacttttttccc

SEQ ID NO: 5816 - DNA, 20 bp, Artificial Sequence
  Description of Artificial Sequence: Synthetic oligonucleotide
ttattctcatttatcctccg

SEQ ID NO: 5817 - DNA, 20 bp, Artificial Sequence
  Description of Artificial Sequence: Synthetic oligonucleotide
gactttaccttcttattccc

SEQ ID NO: 5818 - DNA, 20 bp, Artificial Sequence
  Description of Artificial Sequence: Synthetic oligonucleotide
ttccattctttcttattccc

SEQ ID NO: 5819 - DNA, 19 bp, Artificial Sequence
  Description of Artificial Sequence: Synthetic oligonucleotide
attcttttctttttcaccg

SEQ ID NO: 5820 - DNA, 20 bp, Artificial Sequence
  Description of Artificial Sequence: Synthetic oligonucleotide
gtcattgctatttttttccg

SEQ ID NO: 5821 - DNA, 22 bp, Artificial Sequence
  Description of Artificial Sequence: Synthetic oligonucleotide
ttttcttgcccttttttttccg

SEQ ID NO: 5822 - DNA, 20 bp, Artificial Sequence
  Description of Artificial Sequence: Synthetic oligonucleotide
attcttctttcacttaccgc

SEQ ID NO: 5823 - DNA, 21 bp, Artificial Sequence
  Description of Artificial Sequence: Synthetic oligonucleotide
cttttctcttcttgtttacct

SEQ ID NO: 5824 - DNA, 20 bp, Artificial Sequence
  Description of Artificial Sequence: Synthetic oligonucleotide
ggttttcaatcttttccccc

SEQ ID NO: 5825 - DNA, 20 bp, Artificial Sequence
  Description of Artificial Sequence: Synthetic oligonucleotide
aatacttcttattctctccg

SEQ ID NO: 5826 - DNA, 20 bp, Artificial Sequence
  Description of Artificial Sequence: Synthetic oligonucleotide
atcttttcgcttttttgccg

SEQ ID NO: 5827 - DNA, 20 bp, Artificial Sequence
  Description of Artificial Sequence: Synthetic oligonucleotide
cttctctataactctctccg

SEQ ID NO: 5828 - DNA, 21 bp, Artificial Sequence
  Description of Artificial Sequence: Synthetic oligonucleotide
tttatttcttttcacgttccg

SEQ ID NO: 5829 - DNA, 20 bp, Artificial Sequence
  Description of Artificial Sequence: Synthetic oligonucleotide
acttatacttctcttctccg

SEQ ID NO: 5830 - DNA, 20 bp, Artificial Sequence
  Description of Artificial Sequence: Synthetic oligonucleotide
gttttttcccactgttcccg

SEQ ID NO: 5831 - DNA, 20 bp, Artificial Sequence
  Description of Artificial Sequence: Synthetic oligonucleotide
ctcttttatacttatctccg

SEQ ID NO: 5832 - DNA, 20 bp, Artificial Sequence
  Description of Artificial Sequence: Synthetic oligonucleotide
ttcttcactcacttttcccg

SEQ ID NO: 5833 - DNA, 20 bp, Artificial Sequence
  Description of Artificial Sequence: Synthetic oligonucleotide
tttttctaaatttgcttccg

SEQ ID NO: 5834 - DNA, 21 bp, Artificial Sequence
  Description of Artificial Sequence: Synthetic oligonucleotide
atcatcactttctttttaccg

SEQ ID NO: 5835 - DNA, 20 bp, Artificial Sequence
  Description of Artificial Sequence: Synthetic oligonucleotide
ctcactttcattccattccg

SEQ ID NO: 5836 - DNA, 20 bp, Artificial Sequence
  Description of Artificial Sequence: Synthetic oligonucleotide
tttcttttctcgcttttccg

SEQ ID NO: 5837 - DNA, 20 bp, Artificial Sequence
  Description of Artificial Sequence: Synthetic oligonucleotide
attttcttctctcttctccg

SEQ ID NO: 5838 - DNA, 20 bp, Artificial Sequence
  Description of Artificial Sequence: Synthetic oligonucleotide
cattttactatttctctccg

SEQ ID NO: 5839 - DNA, 21 bp, Artificial Sequence
  Description of Artificial Sequence: Synthetic oligonucleotide
gtcttgtctattttttccccg

SEQ ID NO: 5840 - DNA, 20 bp, Artificial Sequence
  Description of Artificial Sequence: Synthetic oligonucleotide
tctttatttacggctttccg

SEQ ID NO: 5841 - DNA, 20 bp, Artificial Sequence
  Description of Artificial Sequence: Synthetic oligonucleotide
tggttggcgttatggaggtg

SEQ ID NO: 5842 - DNA, 20 bp, Artificial Sequence
  Description of Artificial Sequence: Synthetic oligonucleotide
cttttttttcatgctttccg

SEQ ID NO: 5843 - DNA, 20 bp, Artificial Sequence
  Description of Artificial Sequence: Synthetic oligonucleotide
attttctcttttttttgccg

SEQ ID NO: 5844 - DNA, 20 bp, Artificial Sequence
  Description of Artificial Sequence: Synthetic oligonucleotide
tcacttctttctattccccg

SEQ ID NO: 5845 - DNA, 19 bp, Artificial Sequence
  Description of Artificial Sequence: Synthetic oligonucleotide
atcttttctttctttgccg

SEQ ID NO: 5846 - DNA, 21 bp, Artificial Sequence
  Description of Artificial Sequence: Synthetic oligonucleotide
tttcttgatcctttttttccg

SEQ ID NO: 5847 - DNA, 20 bp, Artificial Sequence
  Description of Artificial Sequence: Synthetic oligonucleotide
cttttatgtttccctttccg

SEQ ID NO: 5848 - DNA, 20 bp, Artificial Sequence
  Description of Artificial Sequence: Synthetic oligonucleotide
ccttatttattttcttaccg

SEQ ID NO: 5849 - DNA, 20 bp, Artificial Sequence
  Description of Artificial Sequence: Synthetic oligonucleotide
cttcttttctttctcttgtg

SEQ ID NO: 5850 - DNA, 18 bp, Artificial Sequence
  Description of Artificial Sequence: Synthetic oligonucleotide
tttcttttcctttgtccg

SEQ ID NO: 5851 - DNA, 21 bp, Artificial Sequence
  Description of Artificial Sequence: Synthetic oligonucleotide
attccttttcttttttctccg

SEQ ID NO: 5852 - DNA, 20 bp, Artificial Sequence
  Description of Artificial Sequence: Synthetic oligonucleotide
tttatttcacactctttgcc

SEQ ID NO: 5853 - DNA, 20 bp, Artificial Sequence
  Description of Artificial Sequence: Synthetic oligonucleotide
ctttctatatattccttccg

SEQ ID NO: 5854 - DNA, 20 bp, Artificial Sequence
  Description of Artificial Sequence: Synthetic oligonucleotide
tcttttctgtttctgtcccg

SEQ ID NO: 5855 - DNA, 20 bp, Artificial Sequence
  Description of Artificial Sequence: Synthetic oligonucleotide
tttattatctttctctgctg

SEQ ID NO: 5856 - DNA, 20 bp, Artificial Sequence
  Description of Artificial Sequence: Synthetic oligonucleotide
ttttctttctctcatctccg

SEQ ID NO: 5857 - DNA, 20 bp, Artificial Sequence
  Description of Artificial Sequence: Synthetic oligonucleotide
attattgcttttttttgctg

SEQ ID NO: 5858 - DNA, 20 bp, Artificial Sequence
  Description of Artificial Sequence: Synthetic oligonucleotide
tttattcttttttctttgcg

SEQ ID NO: 5859 - DNA, 20 bp, Artificial Sequence
  Description of Artificial Sequence: Synthetic oligonucleotide
agtttcttttctttcttccg

SEQ ID NO: 5860 - DNA, 20 bp, Artificial Sequence
  Description of Artificial Sequence: Synthetic oligonucleotide
accttataactcttcttccg

SEQ ID NO: 5861 - DNA, 20 bp, Artificial Sequence
  Description of Artificial Sequence: Synthetic oligonucleotide
tgttcacgtttttttttctg

SEQ ID NO: 5862 - DNA, 20 bp, Artificial Sequence
  Description of Artificial Sequence: Synthetic oligonucleotide
gtctattattatttctgccg

SEQ ID NO: 5863 - DNA, 20 bp, Artificial Sequence
  Description of Artificial Sequence: Synthetic oligonucleotide
ttcatactttctttcttgcc

SEQ ID NO: 5864 - DNA, 20 bp, Artificial Sequence
  Description of Artificial Sequence: Synthetic oligonucleotide
atctttatcttcttctcccg

SEQ ID NO: 5865 - DNA, 19 bp, Artificial Sequence
  Description of Artificial Sequence: Synthetic oligonucleotide
ttatttttttttctgtccg

SEQ ID NO: 5866 - DNA, 20 bp, Artificial Sequence
  Description of Artificial Sequence: Synthetic oligonucleotide
gactctttatttcttttccc

SEQ ID NO: 5867 - DNA, 20 bp, Artificial Sequence
  Description of Artificial Sequence: Synthetic oligonucleotide
cctttttgttactttatccc

SEQ ID NO: 5868 - DNA, 20 bp, Artificial Sequence
  Description of Artificial Sequence: Synthetic oligonucleotide
tttttcataactttcctctg

SEQ ID NO: 5869 - DNA, 20 bp, Artificial Sequence
  Description of Artificial Sequence: Synthetic oligonucleotide
acacttatcactttttaccg

SEQ ID NO: 5870 - DNA, 20 bp, Artificial Sequence
  Description of Artificial Sequence: Synthetic oligonucleotide
ctagggtgaagggtggatgc

SEQ ID NO: 5871 - DNA, 20 bp, Artificial Sequence
  Description of Artificial Sequence: Synthetic oligonucleotide
ttttacctcgtttttctgtg

SEQ ID NO: 5872 - DNA, 18 bp, Artificial Sequence
  Description of Artificial Sequence: Synthetic oligonucleotide
gctttcgttctgcctccc

SEQ ID NO: 5873 - DNA, 20 bp, Artificial Sequence
  Description of Artificial Sequence: Synthetic oligonucleotide
cttcatgtttagctttcgcc

SEQ ID NO: 5874 - DNA, 19 bp, Artificial Sequence
  Description of Artificial Sequence: Synthetic oligonucleotide
atctttctttcttctgccg

SEQ ID NO: 5875 - DNA, 21 bp, Artificial Sequence
  Description of Artificial Sequence: Synthetic oligonucleotide
atttcgctaatttttttaccg

SEQ ID NO: 5876 - DNA, 20 bp, Artificial Sequence
  Description of Artificial Sequence: Synthetic oligonucleotide
gccttcttttctttctcccg

SEQ ID NO: 5877 - DNA, 20 bp, Artificial Sequence
  Description of Artificial Sequence: Synthetic oligonucleotide
ttattctctattcttttgcc

SEQ ID NO: 5878 - DNA, 20 bp, Artificial Sequence
  Description of Artificial Sequence: Synthetic oligonucleotide
tctttcattttctctctctg

SEQ ID NO: 5879 - DNA, 22 bp, Artificial Sequence
  Description of Artificial Sequence: Synthetic oligonucleotide
tttgtaatgttttttttttccg

SEQ ID NO: 5880 - DNA, 22 bp, Artificial Sequence
  Description of Artificial Sequence: Synthetic oligonucleotide
tcattactgttttttttatccg

SEQ ID NO: 5881 - DNA, 22 bp, Artificial Sequence
  Description of Artificial Sequence: Synthetic oligonucleotide
ttttttcacttttttcgccccg

SEQ ID NO: 5882 - DNA, 20 bp, Artificial Sequence
  Description of Artificial Sequence: Synthetic oligonucleotide
attttttttgtcgcttcccg

SEQ ID NO: 5883 - DNA, 18 bp, Artificial Sequence
  Description of Artificial Sequence: Synthetic oligonucleotide
atttcttttcctttaccg

SEQ ID NO: 5884 - DNA, 20 bp, Artificial Sequence
  Description of Artificial Sequence: Synthetic oligonucleotide
tactcttttatttcttcccg

SEQ ID NO: 5885 - DNA, 21 bp, Artificial Sequence
  Description of Artificial Sequence: Synthetic oligonucleotide
tttcttactttttttcatccg

SEQ ID NO: 5886 - DNA, 21 bp, Artificial Sequence
  Description of Artificial Sequence: Synthetic oligonucleotide
tttttcaattatttctgtccg

SEQ ID NO: 5887 - DNA, 21 bp, Artificial Sequence
  Description of Artificial Sequence: Synthetic oligonucleotide
tttttgtcatttcttgttccg

SEQ ID NO: 5888 - DNA, 20 bp, Artificial Sequence
  Description of Artificial Sequence: Synthetic oligonucleotide
ttttagttatgttttgttcc

SEQ ID NO: 5889 - DNA, 20 bp, Artificial Sequence
  Description of Artificial Sequence: Synthetic oligonucleotide
tttcttttctactcattctg

SEQ ID NO: 5890 - DNA, 20 bp, Artificial Sequence
  Description of Artificial Sequence: Synthetic oligonucleotide
gttttttgtaactgcttccc

SEQ ID NO: 5891 - DNA, 21 bp, Artificial Sequence
  Description of Artificial Sequence: Synthetic oligonucleotide
ttttttttattgttgtttctg

SEQ ID NO: 5892 - DNA, 20 bp, Artificial Sequence
  Description of Artificial Sequence: Synthetic oligonucleotide
ctcttatcgttatttttccg

SEQ ID NO: 5893 - DNA, 21 bp, Artificial Sequence
  Description of Artificial Sequence: Synthetic oligonucleotide
ttcacattatttttttttccg

SEQ ID NO: 5894 - DNA, 20 bp, Artificial Sequence
  Description of Artificial Sequence: Synthetic oligonucleotide
ctcattatctatctcttccg

SEQ ID NO: 5895 - DNA, 20 bp, Artificial Sequence
  Description of Artificial Sequence: Synthetic oligonucleotide
tctttttatcactatttccc

SEQ ID NO: 5896 - DNA, 22 bp, Artificial Sequence
  Description of Artificial Sequence: Synthetic oligonucleotide
cctttcatttttttttttgccg

SEQ ID NO: 5897 - DNA, 20 bp, Artificial Sequence
  Description of Artificial Sequence: Synthetic oligonucleotide
tattgttttctcgttttgtg

SEQ ID NO: 5898 - DNA, 20 bp, Artificial Sequence
  Description of Artificial Sequence: Synthetic oligonucleotide
catctctttcattttatccg

SEQ ID NO: 5899 - DNA, 21 bp, Artificial Sequence
  Description of Artificial Sequence: Synthetic oligonucleotide
gttctttcatgtttttttccc

SEQ ID NO: 5900 - DNA, 22 bp, Artificial Sequence
  Description of Artificial Sequence: Synthetic oligonucleotide
aatttctcgtttttttttgctg

SEQ ID NO: 5901 - DNA, 20 bp, Artificial Sequence
  Description of Artificial Sequence: Synthetic oligonucleotide
gttgcttactttttttccgc

SEQ ID NO: 5902 - DNA, 20 bp, Artificial Sequence
  Description of Artificial Sequence: Synthetic oligonucleotide
ttactcattttatttctccg

SEQ ID NO: 5903 - DNA, 19 bp, Artificial Sequence
  Description of Artificial Sequence: Synthetic oligonucleotide
tttttcctttttttatccg

SEQ ID NO: 5904 - DNA, 22 bp, Artificial Sequence
  Description of Artificial Sequence: Synthetic oligonucleotide
ccatttgtttttttttcttccg

SEQ ID NO: 5905 - DNA, 20 bp, Artificial Sequence
  Description of Artificial Sequence: Synthetic oligonucleotide
tactttaatctttttttccg

SEQ ID NO: 5906 - DNA, 19 bp, Artificial Sequence
  Description of Artificial Sequence: Synthetic oligonucleotide
tcgtttatttctttttccg

SEQ ID NO: 5907 - DNA, 20 bp, Artificial Sequence
  Description of Artificial Sequence: Synthetic oligonucleotide
ctttctctttaattcttccg

SEQ ID NO: 5908 - DNA, 19 bp, Artificial Sequence
  Description of Artificial Sequence: Synthetic oligonucleotide
cctttttctttcctttccg

SEQ ID NO: 5909 - DNA, 20 bp, Artificial Sequence
  Description of Artificial Sequence: Synthetic oligonucleotide
tccttgtcgttttgcgtccc

SEQ ID NO: 5910 - DNA, 20 bp, Artificial Sequence
  Description of Artificial Sequence: Synthetic oligonucleotide
tcctttcgttctgccctccg

SEQ ID NO: 5911 - DNA, 19 bp, Artificial Sequence
  Description of Artificial Sequence: Synthetic oligonucleotide
tcttctggcttatcgtccc

SEQ ID NO: 5912 - DNA, 18 bp, Artificial Sequence
  Description of Artificial Sequence: Synthetic oligonucleotide
tcctttcgttgccctccc

SEQ ID NO: 5913 - DNA, 20 bp, Artificial Sequence
  Description of Artificial Sequence: Synthetic oligonucleotide
gcccttcgttcttccctccc

SEQ ID NO: 5914 - DNA, 20 bp, Artificial Sequence
  Description of Artificial Sequence: Synthetic oligonucleotide
tcctctcgttctgccctccc

SEQ ID NO: 5915 - DNA, 20 bp, Artificial Sequence
  Description of Artificial Sequence: Synthetic oligonucleotide
atagtctggacttgccgccc

SEQ ID NO: 5916 - DNA, 19 bp, Artificial Sequence
  Description of Artificial Sequence: Synthetic oligonucleotide
tcctggcttgtcgtgtccc

SEQ ID NO: 5917 - DNA, 19 bp, Artificial Sequence
  Description of Artificial Sequence: Synthetic oligonucleotide
tcttttgccttcttttccg

SEQ ID NO: 5918 - DNA, 20 bp, Artificial Sequence
  Description of Artificial Sequence: Synthetic oligonucleotide
tttcacttttatttctgccg

SEQ ID NO: 5919 - DNA, 20 bp, Artificial Sequence
  Description of Artificial Sequence: Synthetic oligonucleotide
tttgggagtagggtgtgccg

SEQ ID NO: 5920 - DNA, 21 bp, Artificial Sequence
  Description of Artificial Sequence: Synthetic oligonucleotide
tttggggtttttcccgtgccg

SEQ ID NO: 5921 - DNA, 21 bp, Artificial Sequence
  Description of Artificial Sequence: Synthetic oligonucleotide
atttgaagggtgatgggtccg

SEQ ID NO: 5922 - DNA, 20 bp, Artificial Sequence
  Description of Artificial Sequence: Synthetic oligonucleotide
tttccattcaatcttctccg

SEQ ID NO: 5923 - DNA, 20 bp, Artificial Sequence
  Description of Artificial Sequence: Synthetic oligonucleotide
tttttgtctacttttcgccg

SEQ ID NO: 5924 - DNA, 20 bp, Artificial Sequence
  Description of Artificial Sequence: Synthetic oligonucleotide
cttttccttactattttgcc

SEQ ID NO: 5925 - DNA, 20 bp, Artificial Sequence
  Description of Artificial Sequence: Synthetic oligonucleotide
atgcttggagtagggaggcg

SEQ ID NO: 5926 - DNA, 20 bp, Artificial Sequence
  Description of Artificial Sequence: Synthetic oligonucleotide
tcacttttttacttcctgcc

SEQ ID NO: 5927 - DNA, 19 bp, Artificial Sequence
  Description of Artificial Sequence: Synthetic oligonucleotide
atctttcttatttttgccg

SEQ ID NO: 5928 - DNA, 19 bp, Artificial Sequence
  Description of Artificial Sequence: Synthetic oligonucleotide
tttggggtagggtgttccg

SEQ ID NO: 5929 - DNA, 18 bp, Artificial Sequence
  Description of Artificial Sequence: Synthetic oligonucleotide
tcttactttttcactccg

SEQ ID NO: 5930 - DNA, 20 bp, Artificial Sequence
  Description of Artificial Sequence: Synthetic oligonucleotide
ttgttttcgttttttttgcc

SEQ ID NO: 5931 - DNA, 18 bp, Artificial Sequence
  Description of Artificial Sequence: Synthetic oligonucleotide
gtttcgttctgccctccc

SEQ ID NO: 5932 - DNA, 21 bp, Artificial Sequence
  Description of Artificial Sequence: Synthetic oligonucleotide
ctttcactttttttctctccc

SEQ ID NO: 5933 - DNA, 20 bp, Artificial Sequence
  Description of Artificial Sequence: Synthetic oligonucleotide
gttggcgtaggggggttccg

SEQ ID NO: 5934 - DNA, 20 bp, Artificial Sequence
  Description of Artificial Sequence: Synthetic oligonucleotide
ttttactcttttccgctccg

SEQ ID NO: 5935 - DNA, 19 bp, Artificial Sequence
  Description of Artificial Sequence: Synthetic oligonucleotide
tctttttaacttttctccg

SEQ ID NO: 5936 - DNA, 21 bp, Artificial Sequence
  Description of Artificial Sequence: Synthetic oligonucleotide
atttgcttttttttggttccg

SEQ ID NO: 5937 - DNA, 20 bp, Artificial Sequence
  Description of Artificial Sequence: Synthetic oligonucleotide
ctttattcttgttgtctccg

SEQ ID NO: 5938 - DNA, 20 bp, Artificial Sequence
  Description of Artificial Sequence: Synthetic oligonucleotide
cattcattttctttctaccg

SEQ ID NO: 5939 - DNA, 18 bp, Artificial Sequence
  Description of Artificial Sequence: Synthetic oligonucleotide
tttcttgtttcctttccg

SEQ ID NO: 5940 - DNA, 20 bp, Artificial Sequence
  Description of Artificial Sequence: Synthetic oligonucleotide
ttatttgtatgttttttccg

SEQ ID NO: 5941 - DNA, 20 bp, Artificial Sequence
  Description of Artificial Sequence: Synthetic oligonucleotide
acttcgcttttatttatccc

SEQ ID NO: 5942 - DNA, 20 bp, Artificial Sequence
  Description of Artificial Sequence: Synthetic oligonucleotide
ctcttattctctcatttccg

SEQ ID NO: 5943 - DNA, 20 bp, Artificial Sequence
  Description of Artificial Sequence: Synthetic oligonucleotide
atttaatgttctcttttccg

SEQ ID NO: 5944 - DNA, 21 bp, Artificial Sequence
  Description of Artificial Sequence: Synthetic oligonucleotide
ttttttgttcccttttgcccg

SEQ ID NO: 5945 - DNA, 20 bp, Artificial Sequence
  Description of Artificial Sequence: Synthetic oligonucleotide
ttttgtgttttatgtatccg

SEQ ID NO: 5946 - DNA, 20 bp, Artificial Sequence
  Description of Artificial Sequence: Synthetic oligonucleotide
atcattttttcatcccaccg

SEQ ID NO: 5947 - DNA, 20 bp, Artificial Sequence
  Description of Artificial Sequence: Synthetic oligonucleotide
aacttttcttctctcgtccg

SEQ ID NO: 5948 - DNA, 21 bp, Artificial Sequence
  Description of Artificial Sequence: Synthetic oligonucleotide
cttgtgttttttttttttgcc

SEQ ID NO: 5949 - DNA, 20 bp, Artificial Sequence
  Description of Artificial Sequence: Synthetic oligonucleotide
atttttttgatccttctccg

SEQ ID NO: 5950 - DNA, 21 bp, Artificial Sequence
  Description of Artificial Sequence: Synthetic oligonucleotide
gatttttctttttttgtgccg

SEQ ID NO: 5951 - DNA, 20 bp, Artificial Sequence
  Description of Artificial Sequence: Synthetic oligonucleotide
ctctttcttcgcttttcccg

SEQ ID NO: 5952 - DNA, 20 bp, Artificial Sequence
  Description of Artificial Sequence: Synthetic oligonucleotide
gctcttttctttcttcaccc

SEQ ID NO: 5953 - DNA, 20 bp, Artificial Sequence
  Description of Artificial Sequence: Synthetic oligonucleotide
atcttttcgtttttttaccg

SEQ ID NO: 5954 - DNA, 20 bp, Artificial Sequence
  Description of Artificial Sequence: Synthetic oligonucleotide
taactattttctttctgccc

SEQ ID NO: 5955 - DNA, 20 bp, Artificial Sequence
  Description of Artificial Sequence: Synthetic oligonucleotide
tttttgtcttgctttttccg

SEQ ID NO: 5956 - DNA, 20 bp, Artificial Sequence
  Description of Artificial Sequence: Synthetic oligonucleotide
tttcttttcgttacttgccg

SEQ ID NO: 5957 - DNA, 20 bp, Artificial Sequence
  Description of Artificial Sequence: Synthetic oligonucleotide
gctctattcttttcccaccg

SEQ ID NO: 5958 - DNA, 21 bp, Artificial Sequence
  Description of Artificial Sequence: Synthetic oligonucleotide
gcttttcttcctttttttccg

SEQ ID NO: 5959 - DNA, 20 bp, Artificial Sequence
  Description of Artificial Sequence: Synthetic oligonucleotide
accttttgatttttttgccc

SEQ ID NO: 5960 - DNA, 20 bp, Artificial Sequence
  Description of Artificial Sequence: Synthetic oligonucleotide
gctttctttacgcttttccc

SEQ ID NO: 5961 - DNA, 20 bp, Artificial Sequence
  Description of Artificial Sequence: Synthetic oligonucleotide
attatttctttcgtttgccg

SEQ ID NO: 5962 - DNA, 19 bp, Artificial Sequence
  Description of Artificial Sequence: Synthetic oligonucleotide
cgttttctacttctttccg

SEQ ID NO: 5963 - DNA, 22 bp, Artificial Sequence
  Description of Artificial Sequence: Synthetic oligonucleotide
ctttcacttttttttccctccg

SEQ ID NO: 5964 - DNA, 22 bp, Artificial Sequence
  Description of Artificial Sequence: Synthetic oligonucleotide
tttttcattccctttttttccg

SEQ ID NO: 5965 - DNA, 20 bp, Artificial Sequence
  Description of Artificial Sequence: Synthetic oligonucleotide
tttggggggagggggttccg

SEQ ID NO: 5966 - DNA, 20 bp, Artificial Sequence
  Description of Artificial Sequence: Synthetic oligonucleotide
tttcctttgctttctctccg

SEQ ID NO: 5967 - DNA, 21 bp, Artificial Sequence
  Description of Artificial Sequence: Synthetic oligonucleotide
caattgtttttttttcaccgc

SEQ ID NO: 5968 - DNA, 21 bp, Artificial Sequence
  Description of Artificial Sequence: Synthetic oligonucleotide
ttcatttttttattccctgtg

SEQ ID NO: 5969 - DNA, 20 bp, Artificial Sequence
  Description of Artificial Sequence: Synthetic oligonucleotide
cattctttgttcttctacgc

SEQ ID NO: 5970 - DNA, 21 bp, Artificial Sequence
  Description of Artificial Sequence: Synthetic oligonucleotide
tttgttcttttctttttcccc

SEQ ID NO: 5971 - DNA, 20 bp, Artificial Sequence
  Description of Artificial Sequence: Synthetic oligonucleotide
ttcttatttatgtctttccg

SEQ ID NO: 5972 - DNA, 20 bp, Artificial Sequence
  Description of Artificial Sequence: Synthetic oligonucleotide
aattctatttatttttgccg

SEQ ID NO: 5973 - DNA, 20 bp, Artificial Sequence
  Description of Artificial Sequence: Synthetic oligonucleotide
cctttattattttttacccg

SEQ ID NO: 5974 - DNA, 20 bp, Artificial Sequence
  Description of Artificial Sequence: Synthetic oligonucleotide
acttcttcatattctcaccg

SEQ ID NO: 5975 - DNA, 20 bp, Artificial Sequence
  Description of Artificial Sequence: Synthetic oligonucleotide
ctttttctatttagtttccg

SEQ ID NO: 5976 - DNA, 20 bp, Artificial Sequence
  Description of Artificial Sequence: Synthetic oligonucleotide
acttgttgttctttttaccg

SEQ ID NO: 5977 - DNA, 21 bp, Artificial Sequence
  Description of Artificial Sequence: Synthetic oligonucleotide
acattacttttttttttcccg

SEQ ID NO: 5978 - DNA, 20 bp, Artificial Sequence
  Description of Artificial Sequence: Synthetic oligonucleotide
ctttttgttttcttttactg

SEQ ID NO: 5979 - DNA, 20 bp, Artificial Sequence
  Description of Artificial Sequence: Synthetic oligonucleotide
ttttcgctatttttcaccgc

SEQ ID NO: 5980 - DNA, 20 bp, Artificial Sequence
  Description of Artificial Sequence: Synthetic oligonucleotide
ttttcactttctttttgctc

SEQ ID NO: 5981 - DNA, 20 bp, Artificial Sequence
  Description of Artificial Sequence: Synthetic oligonucleotide
tctcatttgcttttatcccg

SEQ ID NO: 5982 - DNA, 20 bp, Artificial Sequence
  Description of Artificial Sequence: Synthetic oligonucleotide
actctagtttattttcaccg

SEQ ID NO: 5983 - DNA, 21 bp, Artificial Sequence
  Description of Artificial Sequence: Synthetic oligonucleotide
acttttttcgttttccaaccg

SEQ ID NO: 5984 - DNA, 20 bp, Artificial Sequence
  Description of Artificial Sequence: Synthetic oligonucleotide
acttttctcgcactttaccg

SEQ ID NO: 5985 - DNA, 21 bp, Artificial Sequence
  Description of Artificial Sequence: Synthetic oligonucleotide
aaccttgtttttctttcaccg

SEQ ID NO: 5986 - DNA, 20 bp, Artificial Sequence
  Description of Artificial Sequence: Synthetic oligonucleotide
aattcctcatattttctccg

SEQ ID NO: 5987 - DNA, 20 bp, Artificial Sequence
  Description of Artificial Sequence: Synthetic oligonucleotide
gtttctatttctctccgccg

SEQ ID NO: 5988 - DNA, 20 bp, Artificial Sequence
  Description of Artificial Sequence: Synthetic oligonucleotide
atactttctttttaccactg

SEQ ID NO: 5989 - DNA, 20 bp, Artificial Sequence
  Description of Artificial Sequence: Synthetic oligonucleotide
tcttgttacttttcttaccg

SEQ ID NO: 5990 - DNA, 20 bp, Artificial Sequence
  Description of Artificial Sequence: Synthetic oligonucleotide
tttccaatcctttccttccg

SEQ ID NO: 5991 - DNA, 20 bp, Artificial Sequence
  Description of Artificial Sequence: Synthetic oligonucleotide
ttattattatctttctgccc

SEQ ID NO: 5992 - DNA, 20 bp, Artificial Sequence
  Description of Artificial Sequence: Synthetic oligonucleotide
tttcaaattttacttttccg

SEQ ID NO: 5993 - DNA, 20 bp, Artificial Sequence
  Description of Artificial Sequence: Synthetic oligonucleotide
tctctttttcattgttcccg

SEQ ID NO: 5994 - DNA, 20 bp, Artificial Sequence
  Description of Artificial Sequence: Synthetic oligonucleotide
ttactttttcttttggcgtc

SEQ ID NO: 5995 - DNA, 20 bp, Artificial Sequence
  Description of Artificial Sequence: Synthetic oligonucleotide
ccttttttttgttcttcccg

SEQ ID NO: 5996 - DNA, 20 bp, Artificial Sequence
  Description of Artificial Sequence: Synthetic oligonucleotide
cattttctgttttttttccg

SEQ ID NO: 5997 - DNA, 20 bp, Artificial Sequence
  Description of Artificial Sequence: Synthetic oligonucleotide
tttcaattcccctctttccg

SEQ ID NO: 5998 - DNA, 20 bp, Artificial Sequence
  Description of Artificial Sequence: Synthetic oligonucleotide
cattttcctttctccttccg

SEQ ID NO: 5999 - DNA, 20 bp, Artificial Sequence
  Description of Artificial Sequence: Synthetic oligonucleotide
gttatattggcttttttccg

SEQ ID NO: 6000 - DNA, 21 bp, Artificial Sequence
  Description of Artificial Sequence: Synthetic oligonucleotide
atattttgttttttcttgccc

SEQ ID NO: 6001 - DNA, 20 bp, Artificial Sequence
  Description of Artificial Sequence: Synthetic oligonucleotide
gattttttctctcttttccc

SEQ ID NO: 6002 - DNA, 20 bp, Artificial Sequence
  Description of Artificial Sequence: Synthetic oligonucleotide
atttttccttaccctctccg

SEQ ID NO: 6003 - DNA, 20 bp, Artificial Sequence
  Description of Artificial Sequence: Synthetic oligonucleotide
cactttgttcttttctcccg

SEQ ID NO: 6004 - DNA, 20 bp, Artificial Sequence
  Description of Artificial Sequence: Synthetic oligonucleotide
atctttagctttttacaccg

SEQ ID NO: 6005 - DNA, 20 bp, Artificial Sequence
  Description of Artificial Sequence: Synthetic oligonucleotide
tcattcactttttctttccc

SEQ ID NO: 6006 - DNA, 22 bp, Artificial Sequence
  Description of Artificial Sequence: Synthetic oligonucleotide
tgtttttttttccctttccccg

SEQ ID NO: 6007 - DNA, 20 bp, Artificial Sequence
  Description of Artificial Sequence: Synthetic oligonucleotide
tttgggagtagggtgttcag

SEQ ID NO: 6008 - DNA, 20 bp, Artificial Sequence
  Description of Artificial Sequence: Synthetic oligonucleotide
attcttctattttttcaccg

SEQ ID NO: 6009 - DNA, 19 bp, Artificial Sequence
  Description of Artificial Sequence: Synthetic oligonucleotide
cttttattcactttttccg

SEQ ID NO: 6010 - DNA, 20 bp, Artificial Sequence
  Description of Artificial Sequence: Synthetic oligonucleotide
ttttctttgtttttacgcgc

SEQ ID NO: 6011 - DNA, 20 bp, Artificial Sequence
  Description of Artificial Sequence: Synthetic oligonucleotide
gcttttttactttcttaccg

SEQ ID NO: 6012 - DNA, 21 bp, Artificial Sequence
  Description of Artificial Sequence: Synthetic oligonucleotide
atttatctattttttttgctg

SEQ ID NO: 6013 - DNA, 21 bp, Artificial Sequence
  Description of Artificial Sequence: Synthetic oligonucleotide
tctctttatttttttcttccg

SEQ ID NO: 6014 - DNA, 20 bp, Artificial Sequence
  Description of Artificial Sequence: Synthetic oligonucleotide
ccttattttttgccttcccg

SEQ ID NO: 6015 - DNA, 22 bp, Artificial Sequence
  Description of Artificial Sequence: Synthetic oligonucleotide
tttctcagcttttttttttccg

SEQ ID NO: 6016 - DNA, 20 bp, Artificial Sequence
  Description of Artificial Sequence: Synthetic oligonucleotide
cttttggcttatttttcccg

SEQ ID NO: 6017 - DNA, 20 bp, Artificial Sequence
  Description of Artificial Sequence: Synthetic oligonucleotide
ttttttatatcgcgtttccg

SEQ ID NO: 6018 - DNA, 20 bp, Artificial Sequence
  Description of Artificial Sequence: Synthetic oligonucleotide
ttacttttcttttcttcccc

SEQ ID NO: 6019 - DNA, 18 bp, Artificial Sequence
  Description of Artificial Sequence: Synthetic oligonucleotide
ttttctatcttttgtccg

SEQ ID NO: 6020 - DNA, 20 bp, Artificial Sequence
  Description of Artificial Sequence: Synthetic oligonucleotide
cttttttttttttcccaccg

SEQ ID NO: 6021 - DNA, 20 bp, Artificial Sequence
  Description of Artificial Sequence: Synthetic oligonucleotide
tgttcactcaattttttccg

SEQ ID NO: 6022 - DNA, 20 bp, Artificial Sequence
  Description of Artificial Sequence: Synthetic oligonucleotide
tttatttttttctcgtcccg

SEQ ID NO: 6023 - DNA, 20 bp, Artificial Sequence
  Description of Artificial Sequence: Synthetic oligonucleotide
ctttttgttttacttttgtg

SEQ ID NO: 6024 - DNA, 20 bp, Artificial Sequence
  Description of Artificial Sequence: Synthetic oligonucleotide
ctttcttttccacttttccg

SEQ ID NO: 6025 - DNA, 21 bp, Artificial Sequence
  Description of Artificial Sequence: Synthetic oligonucleotide
ccatttgttctttttcttccg

SEQ ID NO: 6026 - DNA, 20 bp, Artificial Sequence
  Description of Artificial Sequence: Synthetic oligonucleotide
cttcactttttttctctccg

SEQ ID NO: 6027 - DNA, 21 bp, Artificial Sequence
  Description of Artificial Sequence: Synthetic oligonucleotide
atttttggtatttttttaccg

SEQ ID NO: 6028 - DNA, 20 bp, Artificial Sequence
  Description of Artificial Sequence: Synthetic oligonucleotide
tttactcgttatttttgccg

SEQ ID NO: 6029 - DNA, 21 bp, Artificial Sequence
  Description of Artificial Sequence: Synthetic oligonucleotide
atcttgctgctttttttaccg

SEQ ID NO: 6030 - DNA, 20 bp, Artificial Sequence
  Description of Artificial Sequence: Synthetic oligonucleotide
atttgctcctttttttcccg

SEQ ID NO: 6031 - DNA, 19 bp, Artificial Sequence
  Description of Artificial Sequence: Synthetic oligonucleotide
agtttttttatttgttgcc

SEQ ID NO: 6032 - DNA, 19 bp, Artificial Sequence
  Description of Artificial Sequence: Synthetic oligonucleotide
gttggtgtaggggggtccg

SEQ ID NO: 6033 - DNA, 20 bp, Artificial Sequence
  Description of Artificial Sequence: Synthetic oligonucleotide
ttcgaagggcggtgggtccg

SEQ ID NO: 6034 - DNA, 19 bp, Artificial Sequence
  Description of Artificial Sequence: Synthetic oligonucleotide
tttgaagggtgatgttccg

SEQ ID NO: 6035 - DNA, 21 bp, Artificial Sequence
  Description of Artificial Sequence: Synthetic oligonucleotide
cataggagtagggtggtaccg

SEQ ID NO: 6036 - DNA, 19 bp, Artificial Sequence
  Description of Artificial Sequence: Synthetic oligonucleotide
tccttgtcgtcttcgtccc

SEQ ID NO: 6037 - DNA, 20 bp, Artificial Sequence
  Description of Artificial Sequence: Synthetic oligonucleotide
ttcttgtcgtcttgcgtccc

SEQ ID NO: 6038 - DNA, 20 bp, Artificial Sequence
  Description of Artificial Sequence: Synthetic oligonucleotide
aacctcctcagtcgtgtggc

SEQ ID NO: 6039 - DNA, 20 bp, Artificial Sequence
  Description of Artificial Sequence: Synthetic oligonucleotide
tcctgtcgtctgttctcccc

SEQ ID NO: 6040 - DNA, 19 bp, Artificial Sequence
  Description of Artificial Sequence: Synthetic oligonucleotide
tcctttcgttctgcccccc

SEQ ID NO: 6041 - DNA, 21 bp, Artificial Sequence
  Description of Artificial Sequence: Synthetic oligonucleotide
tctgctgtgcttgatatgccc

SEQ ID NO: 6042 - DNA, 20 bp, Artificial Sequence
  Description of Artificial Sequence: Synthetic oligonucleotide
acttttttctctcttttccg

SEQ ID NO: 6043 - DNA, 20 bp, Artificial Sequence
  Description of Artificial Sequence: Synthetic oligonucleotide
atcctttactttctttgccc

SEQ ID NO: 6044 - DNA, 20 bp, Artificial Sequence
  Description of Artificial Sequence: Synthetic oligonucleotide
ttcttcttctattctcaccg

SEQ ID NO: 6045 - DNA, 20 bp, Artificial Sequence
  Description of Artificial Sequence: Synthetic oligonucleotide
attttctcttattcttgccc

SEQ ID NO: 6046 - DNA, 20 bp, Artificial Sequence
  Description of Artificial Sequence: Synthetic oligonucleotide
tttttccctttcctctgccg

SEQ ID NO: 6047 - DNA, 20 bp, Artificial Sequence
  Description of Artificial Sequence: Synthetic oligonucleotide
gatttctcttgcctttgccc

SEQ ID NO: 6048 - DNA, 22 bp, Artificial Sequence
  Description of Artificial Sequence: Synthetic oligonucleotide
cttttctcttttttttccgcgc

SEQ ID NO: 6049 - DNA, 20 bp, Artificial Sequence
  Description of Artificial Sequence: Synthetic oligonucleotide
gcctctcgttcttccctccc

SEQ ID NO: 6050 - DNA, 20 bp, Artificial Sequence
  Description of Artificial Sequence: Synthetic oligonucleotide
ttcttcttttcctttgtccg

SEQ ID NO: 6051 - DNA, 21 bp, Artificial Sequence
  Description of Artificial Sequence: Synthetic oligonucleotide
tctatttggtacttttttccg

SEQ ID NO: 6052 - DNA, 20 bp, Artificial Sequence
  Description of Artificial Sequence: Synthetic oligonucleotide
ccacacttttcctctttccg

SEQ ID NO: 6053 - DNA, 20 bp, Artificial Sequence
  Description of Artificial Sequence: Synthetic oligonucleotide
ccttacatattcctcttccg

SEQ ID NO: 6054 - DNA, 20 bp, Artificial Sequence
  Description of Artificial Sequence: Synthetic oligonucleotide
tctctatgttcgcttctccg

SEQ ID NO: 6055 - DNA, 20 bp, Artificial Sequence
  Description of Artificial Sequence: Synthetic oligonucleotide
gtttatggaggaggttggtg

SEQ ID NO: 6056 - DNA, 18 bp, Artificial Sequence
  Description of Artificial Sequence: Synthetic oligonucleotide
ccttttactttttctccg

SEQ ID NO: 6057 - DNA, 20 bp, Artificial Sequence
  Description of Artificial Sequence: Synthetic oligonucleotide
cctttgttcctgtatttccg

SEQ ID NO: 6058 - DNA, 22 bp, Artificial Sequence
  Description of Artificial Sequence: Synthetic oligonucleotide
actttttttttgtcttctgccg

SEQ ID NO: 6059 - DNA, 22 bp, Artificial Sequence
  Description of Artificial Sequence: Synthetic oligonucleotide
cctttgtattttttttcatccg

SEQ ID NO: 6060 - DNA, 20 bp, Artificial Sequence
  Description of Artificial Sequence: Synthetic oligonucleotide
atctcgtttcactttcaccg

SEQ ID NO: 6061 - DNA, 20 bp, Artificial Sequence
  Description of Artificial Sequence: Synthetic oligonucleotide
tttattcggtattttctccg

SEQ ID NO: 6062 - DNA, 20 bp, Artificial Sequence
  Description of Artificial Sequence: Synthetic oligonucleotide
tattttccattcaccttccg

SEQ ID NO: 6063 - DNA, 20 bp, Artificial Sequence
  Description of Artificial Sequence: Synthetic oligonucleotide
gtctcacttttttatctccg

SEQ ID NO: 6064 - DNA, 21 bp, Artificial Sequence
  Description of Artificial Sequence: Synthetic oligonucleotide
ttgtttttttattgtgtcccg

SEQ ID NO: 6065 - DNA, 20 bp, Artificial Sequence
  Description of Artificial Sequence: Synthetic oligonucleotide
ttttagcttttttttgtccg

SEQ ID NO: 6066 - DNA, 21 bp, Artificial Sequence
  Description of Artificial Sequence: Synthetic oligonucleotide
agtatctatctttttttgccg

SEQ ID NO: 6067 - DNA, 19 bp, Artificial Sequence
  Description of Artificial Sequence: Synthetic oligonucleotide
ctttttttcatgctttccg

SEQ ID NO: 6068 - DNA, 22 bp, Artificial Sequence
  Description of Artificial Sequence: Synthetic oligonucleotide
tctttttttcattatctccccg

SEQ ID NO: 6069 - DNA, 20 bp, Artificial Sequence
  Description of Artificial Sequence: Synthetic oligonucleotide
gctttctgtccctttttccg

SEQ ID NO: 6070 - DNA, 20 bp, Artificial Sequence
  Description of Artificial Sequence: Synthetic oligonucleotide
tcttcgtttccttttcaccg

SEQ ID NO: 6071 - DNA, 20 bp, Artificial Sequence
  Description of Artificial Sequence: Synthetic oligonucleotide
atctttttttctcacctccg

SEQ ID NO: 6072 - DNA, 20 bp, Artificial Sequence
  Description of Artificial Sequence: Synthetic oligonucleotide
ttttttgtgtttcttgcccc

SEQ ID NO: 6073 - DNA, 20 bp, Artificial Sequence
  Description of Artificial Sequence: Synthetic oligonucleotide
ttttttttgtctttcttccg

SEQ ID NO: 6074 - DNA, 20 bp, Artificial Sequence
  Description of Artificial Sequence: Synthetic oligonucleotide
tttgcccttatctttttccg

SEQ ID NO: 6075 - DNA, 20 bp, Artificial Sequence
  Description of Artificial Sequence: Synthetic oligonucleotide
ttttgttctcttttcttccg

SEQ ID NO: 6076 - DNA, 18 bp, Artificial Sequence
  Description of Artificial Sequence: Synthetic oligonucleotide
ttcgtacttttttttccg

SEQ ID NO: 6077 - DNA, 20 bp, Artificial Sequence
  Description of Artificial Sequence: Synthetic oligonucleotide
ctttttaaactctcactccg

SEQ ID NO: 6078 - DNA, 20 bp, Artificial Sequence
  Description of Artificial Sequence: Synthetic oligonucleotide
ccttttacttttttcctccg

SEQ ID NO: 6079 - DNA, 20 bp, Artificial Sequence
  Description of Artificial Sequence: Synthetic oligonucleotide
gtctttactgtttctccccg

SEQ ID NO: 6080 - DNA, 20 bp, Artificial Sequence
  Description of Artificial Sequence: Synthetic oligonucleotide
tccattttcttttctctccg

SEQ ID NO: 6081 - DNA, 20 bp, Artificial Sequence
  Description of Artificial Sequence: Synthetic oligonucleotide
ccttgtttgtttttttcccg

SEQ ID NO: 6082 - DNA, 20 bp, Artificial Sequence
  Description of Artificial Sequence: Synthetic oligonucleotide
cctttactttttattcccgc

SEQ ID NO: 6083 - DNA, 20 bp, Artificial Sequence
  Description of Artificial Sequence: Synthetic oligonucleotide
tttcttgattttttcctcgg

SEQ ID NO: 6084 - DNA, 20 bp, Artificial Sequence
  Description of Artificial Sequence: Synthetic oligonucleotide
ctttctcttgtcttataccg

SEQ ID NO: 6085 - DNA, 20 bp, Artificial Sequence
  Description of Artificial Sequence: Synthetic oligonucleotide
acttatttgttttcttcctg

SEQ ID NO: 6086 - DNA, 22 bp, Artificial Sequence
  Description of Artificial Sequence: Synthetic oligonucleotide
ttactttctaattttccggccg

SEQ ID NO: 6087 - DNA, 20 bp, Artificial Sequence
  Description of Artificial Sequence: Synthetic oligonucleotide
ttctttctatattttttccg

SEQ ID NO: 6088 - DNA, 20 bp, Artificial Sequence
  Description of Artificial Sequence: Synthetic oligonucleotide
actttttattcatttccctg

SEQ ID NO: 6089 - DNA, 20 bp, Artificial Sequence
  Description of Artificial Sequence: Synthetic oligonucleotide
actttatacttgtttccccg

SEQ ID NO: 6090 - DNA, 20 bp, Artificial Sequence
  Description of Artificial Sequence: Synthetic oligonucleotide
tctttttatcttcattcccg

SEQ ID NO: 6091 - DNA, 20 bp, Artificial Sequence
  Description of Artificial Sequence: Synthetic oligonucleotide
attatctttcactttttccg

SEQ ID NO: 6092 - DNA, 20 bp, Artificial Sequence
  Description of Artificial Sequence: Synthetic oligonucleotide
ctttgtcttaatttctaccg

SEQ ID NO: 6093 - DNA, 20 bp, Artificial Sequence
  Description of Artificial Sequence: Synthetic oligonucleotide
tattcatttctcttttacgc

SEQ ID NO: 6094 - DNA, 20 bp, Artificial Sequence
  Description of Artificial Sequence: Synthetic oligonucleotide
ctctatacaatttctttccg

SEQ ID NO: 6095 - DNA, 20 bp, Artificial Sequence
  Description of Artificial Sequence: Synthetic oligonucleotide
ttactttaattctttttgtg

SEQ ID NO: 6096 - DNA, 20 bp, Artificial Sequence
  Description of Artificial Sequence: Synthetic oligonucleotide
tttttaatttttcgttcccg

SEQ ID NO: 6097 - DNA, 20 bp, Artificial Sequence
  Description of Artificial Sequence: Synthetic oligonucleotide
ttttctctcttttctcaccc

SEQ ID NO: 6098 - DNA, 20 bp, Artificial Sequence
  Description of Artificial Sequence: Synthetic oligonucleotide
tcatttcttttttcccagtg

SEQ ID NO: 6099 - DNA, 21 bp, Artificial Sequence
  Description of Artificial Sequence: Synthetic oligonucleotide
tcttattctttttttcctctg

SEQ ID NO: 6100 - DNA, 20 bp, Artificial Sequence
  Description of Artificial Sequence: Synthetic oligonucleotide
tatcttcttttccttcgctg

SEQ ID NO: 6101 - DNA, 20 bp, Artificial Sequence
  Description of Artificial Sequence: Synthetic oligonucleotide
ttgttttttattctattccg

SEQ ID NO: 6102 - DNA, 20 bp, Artificial Sequence
  Description of Artificial Sequence: Synthetic oligonucleotide
cattttatcctgttcatccg

SEQ ID NO: 6103 - DNA, 20 bp, Artificial Sequence
  Description of Artificial Sequence: Synthetic oligonucleotide
tatattccttgttttctctg

SEQ ID NO: 6104 - DNA, 21 bp, Artificial Sequence
  Description of Artificial Sequence: Synthetic oligonucleotide
atttatcaattctttctaccc

SEQ ID NO: 6105 - DNA, 20 bp, Artificial Sequence
  Description of Artificial Sequence: Synthetic oligonucleotide
cttctgtctcttattttccg

SEQ ID NO: 6106 - DNA, 20 bp, Artificial Sequence
  Description of Artificial Sequence: Synthetic oligonucleotide
tatcttttctcctttggccg

SEQ ID NO: 6107 - DNA, 21 bp, Artificial Sequence
  Description of Artificial Sequence: Synthetic oligonucleotide
tttttctatccttttccactg

SEQ ID NO: 6108 - DNA, 20 bp, Artificial Sequence
  Description of Artificial Sequence: Synthetic oligonucleotide
acttactgtttactttaccg

SEQ ID NO: 6109 - DNA, 20 bp, Artificial Sequence
  Description of Artificial Sequence: Synthetic oligonucleotide
cactttttttctttatcccc

SEQ ID NO: 6110 - DNA, 20 bp, Artificial Sequence
  Description of Artificial Sequence: Synthetic oligonucleotide
ttatcactttctttttacgc

SEQ ID NO: 6111 - DNA, 20 bp, Artificial Sequence
  Description of Artificial Sequence: Synthetic oligonucleotide
tcttttcttttttagctccc

SEQ ID NO: 6112 - DNA, 20 bp, Artificial Sequence
  Description of Artificial Sequence: Synthetic oligonucleotide
tttctatttgtcttcatgtg

SEQ ID NO: 6113 - DNA, 20 bp, Artificial Sequence
  Description of Artificial Sequence: Synthetic oligonucleotide
aactttttcctttatttccg

SEQ ID NO: 6114 - DNA, 21 bp, Artificial Sequence
  Description of Artificial Sequence: Synthetic oligonucleotide
tattgtgatcttttttttccg

SEQ ID NO: 6115 - DNA, 22 bp, Artificial Sequence
  Description of Artificial Sequence: Synthetic oligonucleotide
ttttagcttttttttttgtccg

SEQ ID NO: 6116 - DNA, 21 bp, Artificial Sequence
  Description of Artificial Sequence: Synthetic oligonucleotide
attacttggtttttttcaccg

SEQ ID NO: 6117 - DNA, 20 bp, Artificial Sequence
  Description of Artificial Sequence: Synthetic oligonucleotide
ttcttaattactctctcccg

SEQ ID NO: 6118 - DNA, 20 bp, Artificial Sequence
  Description of Artificial Sequence: Synthetic oligonucleotide
cattcttttcgctttttccg

SEQ ID NO: 6119 - DNA, 20 bp, Artificial Sequence
  Description of Artificial Sequence: Synthetic oligonucleotide
accattatttttctattccc

SEQ ID NO: 6120 - DNA, 21 bp, Artificial Sequence
  Description of Artificial Sequence: Synthetic oligonucleotide
actttttgctgtttttttccc

SEQ ID NO: 6121 - DNA, 20 bp, Artificial Sequence
  Description of Artificial Sequence: Synthetic oligonucleotide
tttactatttattctgtctg

SEQ ID NO: 6122 - DNA, 20 bp, Artificial Sequence
  Description of Artificial Sequence: Synthetic oligonucleotide
gtctttaaatctcttttccc

SEQ ID NO: 6123 - DNA, 19 bp, Artificial Sequence
  Description of Artificial Sequence: Synthetic oligonucleotide
actttactcttctttaccg

SEQ ID NO: 6124 - DNA, 20 bp, Artificial Sequence
  Description of Artificial Sequence: Synthetic oligonucleotide
tttctacacaaccttttccg

SEQ ID NO: 6125 - DNA, 19 bp, Artificial Sequence
  Description of Artificial Sequence: Synthetic oligonucleotide
tcacttttatctctttctg

SEQ ID NO: 6126 - DNA, 22 bp, Artificial Sequence
  Description of Artificial Sequence: Synthetic oligonucleotide
attttccttttttttttcccgc

SEQ ID NO: 6127 - DNA, 20 bp, Artificial Sequence
  Description of Artificial Sequence: Synthetic oligonucleotide
tacttatttcttactctctg

SEQ ID NO: 6128 - DNA, 21 bp, Artificial Sequence
  Description of Artificial Sequence: Synthetic oligonucleotide
ttttttctcttttttccgccg

SEQ ID NO: 6129 - DNA, 20 bp, Artificial Sequence
  Description of Artificial Sequence: Synthetic oligonucleotide
ccgttattctagtttttccg

SEQ ID NO: 6130 - DNA, 19 bp, Artificial Sequence
  Description of Artificial Sequence: Synthetic oligonucleotide
tttcttgtcattttttccg

SEQ ID NO: 6131 - DNA, 20 bp, Artificial Sequence
  Description of Artificial Sequence: Synthetic oligonucleotide
agtttttcacttattttccg

SEQ ID NO: 6132 - DNA, 20 bp, Artificial Sequence
  Description of Artificial Sequence: Synthetic oligonucleotide
tttcaatttccctctttccg

SEQ ID NO: 6133 - DNA, 20 bp, Artificial Sequence
  Description of Artificial Sequence: Synthetic oligonucleotide
cttcataatctttctttccg

SEQ ID NO: 6134 - DNA, 20 bp, Artificial Sequence
  Description of Artificial Sequence: Synthetic oligonucleotide
gttttgctcctttttcaccg

SEQ ID NO: 6135 - DNA, 20 bp, Artificial Sequence
  Description of Artificial Sequence: Synthetic oligonucleotide
tatctttatccctatttccg

SEQ ID NO: 6136 - DNA, 20 bp, Artificial Sequence
  Description of Artificial Sequence: Synthetic oligonucleotide
ttttccttaatcctttcccg

SEQ ID NO: 6137 - DNA, 20 bp, Artificial Sequence
  Description of Artificial Sequence: Synthetic oligonucleotide
ttactttctcttttcttgtc

SEQ ID NO: 6138 - DNA, 20 bp, Artificial Sequence
  Description of Artificial Sequence: Synthetic oligonucleotide
tattcatttctatctttccc

SEQ ID NO: 6139 - DNA, 18 bp, Artificial Sequence
  Description of Artificial Sequence: Synthetic oligonucleotide
ttttgcttttttttcccc

SEQ ID NO: 6140 - DNA, 20 bp, Artificial Sequence
  Description of Artificial Sequence: Synthetic oligonucleotide
atactttaactctcttcccg

SEQ ID NO: 6141 - DNA, 20 bp, Artificial Sequence
  Description of Artificial Sequence: Synthetic oligonucleotide
tctgtttgttcttttcttcc

SEQ ID NO: 6142 - DNA, 20 bp, Artificial Sequence
  Description of Artificial Sequence: Synthetic oligonucleotide
gtctttctttttgccttccg

SEQ ID NO: 6143 - DNA, 21 bp, Artificial Sequence
  Description of Artificial Sequence: Synthetic oligonucleotide
ttttatctttctttttttccc

SEQ ID NO: 6144 - DNA, 21 bp, Artificial Sequence
  Description of Artificial Sequence: Synthetic oligonucleotide
gtttttttttctcctttcccg

SEQ ID NO: 6145 - DNA, 22 bp, Artificial Sequence
  Description of Artificial Sequence: Synthetic oligonucleotide
tttcttttttttcaactccccg

SEQ ID NO: 6146 - DNA, 19 bp, Artificial Sequence
  Description of Artificial Sequence: Synthetic oligonucleotide
cttttcttctctttttccg

SEQ ID NO: 6147 - DNA, 22 bp, Artificial Sequence
  Description of Artificial Sequence: Synthetic oligonucleotide
atctttattttttttctctccg

SEQ ID NO: 6148 - DNA, 21 bp, Artificial Sequence
  Description of Artificial Sequence: Synthetic oligonucleotide
tgtttttttatgcttttgccg

SEQ ID NO: 6149 - DNA, 20 bp, Artificial Sequence
  Description of Artificial Sequence: Synthetic oligonucleotide
gttttcattatttctttgcc

SEQ ID NO: 6150 - DNA, 19 bp, Artificial Sequence
  Description of Artificial Sequence: Synthetic oligonucleotide
tttttccttattctttccg

SEQ ID NO: 6151 - DNA, 20 bp, Artificial Sequence
  Description of Artificial Sequence: Synthetic oligonucleotide
tttctgttttatttcgcccc

SEQ ID NO: 6152 - DNA, 22 bp, Artificial Sequence
  Description of Artificial Sequence: Synthetic oligonucleotide
atagttttgttttttttcgccg

SEQ ID NO: 6153 - DNA, 21 bp, Artificial Sequence
  Description of Artificial Sequence: Synthetic oligonucleotide
ttttgccttaatttgtttccg

SEQ ID NO: 6154 - DNA, 19 bp, Artificial Sequence
  Description of Artificial Sequence: Synthetic oligonucleotide
tttgtttattttttgtccc

SEQ ID NO: 6155 - DNA, 20 bp, Artificial Sequence
  Description of Artificial Sequence: Synthetic oligonucleotide
cttctttctttctttttccc

SEQ ID NO: 6156 - DNA, 20 bp, Artificial Sequence
  Description of Artificial Sequence: Synthetic oligonucleotide
ttattgttttattttttgcc

SEQ ID NO: 6157 - DNA, 21 bp, Artificial Sequence
  Description of Artificial Sequence: Synthetic oligonucleotide
ccttttactttttttcctccg

SEQ ID NO: 6158 - DNA, 21 bp, Artificial Sequence
  Description of Artificial Sequence: Synthetic oligonucleotide
ttatttttttacttcctgctg

SEQ ID NO: 6159 - DNA, 22 bp, Artificial Sequence
  Description of Artificial Sequence: Synthetic oligonucleotide
cattgttttattttttccccgc

SEQ ID NO: 6160 - DNA, 21 bp, Artificial Sequence
  Description of Artificial Sequence: Synthetic oligonucleotide
gtcctgtcgtttgttcgtccc

SEQ ID NO: 6161 - DNA, 20 bp, Artificial Sequence
  Description of Artificial Sequence: Synthetic oligonucleotide
tttgaagggtgatgggaccc

SEQ ID NO: 6162 - DNA, 20 bp, Artificial Sequence
  Description of Artificial Sequence: Synthetic oligonucleotide
cttatggagtagggtggcgc

SEQ ID NO: 6163 - DNA, 20 bp, Artificial Sequence
  Description of Artificial Sequence: Synthetic oligonucleotide
ctttcacttttttccctccg

SEQ ID NO: 6164 - DNA, 21 bp, Artificial Sequence
  Description of Artificial Sequence: Synthetic oligonucleotide
ttttactactttttttgcccg

SEQ ID NO: 6165 - DNA, 20 bp, Artificial Sequence
  Description of Artificial Sequence: Synthetic oligonucleotide
attttctcctttttctgccg

SEQ ID NO: 6166 - DNA, 21 bp, Artificial Sequence
  Description of Artificial Sequence: Synthetic oligonucleotide
ttttatattctgcccgctccg

SEQ ID NO: 6167 - DNA, 20 bp, Artificial Sequence
  Description of Artificial Sequence: Synthetic oligonucleotide
gttattgctcctttttgccg

SEQ ID NO: 6168 - DNA, 20 bp, Artificial Sequence
  Description of Artificial Sequence: Synthetic oligonucleotide
attcatttcttttcttgccg

SEQ ID NO: 6169 - DNA, 20 bp, Artificial Sequence
  Description of Artificial Sequence: Synthetic oligonucleotide
tttctctcttgctcgttccg

SEQ ID NO: 6170 - DNA, 20 bp, Artificial Sequence
  Description of Artificial Sequence: Synthetic oligonucleotide
tctttcactgtcttttgccg

SEQ ID NO: 6171 - DNA, 19 bp, Artificial Sequence
  Description of Artificial Sequence: Synthetic oligonucleotide
accttttcttcctattccg

SEQ ID NO: 6172 - DNA, 20 bp, Artificial Sequence
  Description of Artificial Sequence: Synthetic oligonucleotide
atcgtttactgtttttgccg

SEQ ID NO: 6173 - DNA, 20 bp, Artificial Sequence
  Description of Artificial Sequence: Synthetic oligonucleotide
cttattttactctttctgcc

SEQ ID NO: 6174 - DNA, 20 bp, Artificial Sequence
  Description of Artificial Sequence: Synthetic oligonucleotide
atgcttggagcagggaggtg

SEQ ID NO: 6175 - DNA, 20 bp, Artificial Sequence
  Description of Artificial Sequence: Synthetic oligonucleotide
tttgggggtagggggttccg

SEQ ID NO: 6176 - DNA, 20 bp, Artificial Sequence
  Description of Artificial Sequence: Synthetic oligonucleotide
cgtttcatttttcccttgcc

SEQ ID NO: 6177 - DNA, 21 bp, Artificial Sequence
  Description of Artificial Sequence: Synthetic oligonucleotide
ttttccaggtttttttcccgc

SEQ ID NO: 6178 - DNA, 20 bp, Artificial Sequence
  Description of Artificial Sequence: Synthetic oligonucleotide
attattcctctttttgtccg

SEQ ID NO: 6179 - DNA, 20 bp, Artificial Sequence
  Description of Artificial Sequence: Synthetic oligonucleotide
tttcctgtatttctcatccg

SEQ ID NO: 6180 - DNA, 20 bp, Artificial Sequence
  Description of Artificial Sequence: Synthetic oligonucleotide
tttttagtttgttttcccgc

SEQ ID NO: 6181 - DNA, 22 bp, Artificial Sequence
  Description of Artificial Sequence: Synthetic oligonucleotide
attcttgcttttttttttgccg

SEQ ID NO: 6182 - DNA, 20 bp, Artificial Sequence
  Description of Artificial Sequence: Synthetic oligonucleotide
cctttatctctttgcctccg

SEQ ID NO: 6183 - DNA, 19 bp, Artificial Sequence
  Description of Artificial Sequence: Synthetic oligonucleotide
tttggagtagggtgttccg

SEQ ID NO: 6184 - DNA, 20 bp, Artificial Sequence
  Description of Artificial Sequence: Synthetic oligonucleotide
acttacttatttcccttccg

SEQ ID NO: 6185 - DNA, 20 bp, Artificial Sequence
  Description of Artificial Sequence: Synthetic oligonucleotide
ctttttccatcttattaccg

SEQ ID NO: 6186 - DNA, 20 bp, Artificial Sequence
  Description of Artificial Sequence: Synthetic oligonucleotide
tcttttactgcttatttccg

SEQ ID NO: 6187 - DNA, 20 bp, Artificial Sequence
  Description of Artificial Sequence: Synthetic oligonucleotide
tctttattcctctgcttccg

SEQ ID NO: 6188 - DNA, 20 bp, Artificial Sequence
  Description of Artificial Sequence: Synthetic oligonucleotide
atcttcgtctattttttccg

SEQ ID NO: 6189 - DNA, 20 bp, Artificial Sequence
  Description of Artificial Sequence: Synthetic oligonucleotide
cattacctgtcttttctccg

SEQ ID NO: 6190 - DNA, 18 bp, Artificial Sequence
  Description of Artificial Sequence: Synthetic oligonucleotide
actttcttctctttgccg

SEQ ID NO: 6191 - DNA, 19 bp, Artificial Sequence
  Description of Artificial Sequence: Synthetic oligonucleotide
tttggggttttccgtgccg

SEQ ID NO: 6192 - DNA, 20 bp, Artificial Sequence
  Description of Artificial Sequence: Synthetic oligonucleotide
tcctggcttgtcgttgttcc

SEQ ID NO: 6193 - DNA, 20 bp, Artificial Sequence
  Description of Artificial Sequence: Synthetic oligonucleotide
cctttacttctatcttaccg

SEQ ID NO: 6194 - DNA, 20 bp, Artificial Sequence
  Description of Artificial Sequence: Synthetic oligonucleotide
tttctacactcctttttccg

SEQ ID NO: 6195 - DNA, 20 bp, Artificial Sequence
  Description of Artificial Sequence: Synthetic oligonucleotide
accttttccatttttttccg

SEQ ID NO: 6196 - DNA, 20 bp, Artificial Sequence
  Description of Artificial Sequence: Synthetic oligonucleotide
aatttttgttccctgtaccg

SEQ ID NO: 6197 - DNA, 20 bp, Artificial Sequence
  Description of Artificial Sequence: Synthetic oligonucleotide
tttctttttttatccccgtg

SEQ ID NO: 6198 - DNA, 20 bp, Artificial Sequence
  Description of Artificial Sequence: Synthetic oligonucleotide
tcatttctttctcgcctccg

SEQ ID NO: 6199 - DNA, 20 bp, Artificial Sequence
  Description of Artificial Sequence: Synthetic oligonucleotide
acgctttctccttttctccg

SEQ ID NO: 6200 - DNA, 21 bp, Artificial Sequence
  Description of Artificial Sequence: Synthetic oligonucleotide
tttttgttttgttttttggtg

SEQ ID NO: 6201 - DNA, 20 bp, Artificial Sequence
  Description of Artificial Sequence: Synthetic oligonucleotide
tctttatgttcctttttccc

SEQ ID NO: 6202 - DNA, 20 bp, Artificial Sequence
  Description of Artificial Sequence: Synthetic oligonucleotide
cttttcttttttttccgcgc

SEQ ID NO: 6203 - DNA, 20 bp, Artificial Sequence
  Description of Artificial Sequence: Synthetic oligonucleotide
catttcttcttctttcagcc

SEQ ID NO: 6204 - DNA, 21 bp, Artificial Sequence
  Description of Artificial Sequence: Synthetic oligonucleotide
ttttgtttttctctttttccg

SEQ ID NO: 6205 - DNA, 20 bp, Artificial Sequence
  Description of Artificial Sequence: Synthetic oligonucleotide
tttgggagtagggtgttacg

SEQ ID NO: 6206 - DNA, 20 bp, Artificial Sequence
  Description of Artificial Sequence: Synthetic oligonucleotide
atgcttggagtagggtggtg

SEQ ID NO: 6207 - DNA, 20 bp, Artificial Sequence
  Description of Artificial Sequence: Synthetic oligonucleotide
cttttttcattcgcgttccg

SEQ ID NO: 6208 - DNA, 21 bp, Artificial Sequence
  Description of Artificial Sequence: Synthetic oligonucleotide
atttttcttcttcttttaccg

SEQ ID NO: 6209 - DNA, 20 bp, Artificial Sequence
  Description of Artificial Sequence: Synthetic oligonucleotide
ctcatttttttccgtctccg

SEQ ID NO: 6210 - DNA, 20 bp, Artificial Sequence
  Description of Artificial Sequence: Synthetic oligonucleotide
tctttttatcatctttcctg

SEQ ID NO: 6211 - DNA, 20 bp, Artificial Sequence
  Description of Artificial Sequence: Synthetic oligonucleotide
ctttttactgttcttttctg

SEQ ID NO: 6212 - DNA, 20 bp, Artificial Sequence
  Description of Artificial Sequence: Synthetic oligonucleotide
tttccatatttactttcccg

SEQ ID NO: 6213 - DNA, 20 bp, Artificial Sequence
  Description of Artificial Sequence: Synthetic oligonucleotide
ctttatcgtgtttcttaccg

SEQ ID NO: 6214 - DNA, 20 bp, Artificial Sequence
  Description of Artificial Sequence: Synthetic oligonucleotide
cttactcactactttctccg

SEQ ID NO: 6215 - DNA, 20 bp, Artificial Sequence
  Description of Artificial Sequence: Synthetic oligonucleotide
ggttcttttttctccatccc

SEQ ID NO: 6216 - DNA, 20 bp, Artificial Sequence
  Description of Artificial Sequence: Synthetic oligonucleotide
taccactttatttttccccg

SEQ ID NO: 6217 - DNA, 20 bp, Artificial Sequence
  Description of Artificial Sequence: Synthetic oligonucleotide
tttttcagtctatttttccg

SEQ ID NO: 6218 - DNA, 20 bp, Artificial Sequence
  Description of Artificial Sequence: Synthetic oligonucleotide
attcttttactctgctaccg

SEQ ID NO: 6219 - DNA, 21 bp, Artificial Sequence
  Description of Artificial Sequence: Synthetic oligonucleotide
ctttttcgtttttttcttccg

SEQ ID NO: 6220 - DNA, 22 bp, Artificial Sequence
  Description of Artificial Sequence: Synthetic oligonucleotide
atttttgtattcttttttgccc

SEQ ID NO: 6221 - DNA, 20 bp, Artificial Sequence
  Description of Artificial Sequence: Synthetic oligonucleotide
ccatttacacttattttccg

SEQ ID NO: 6222 - DNA, 20 bp, Artificial Sequence
  Description of Artificial Sequence: Synthetic oligonucleotide
tttttgttaatccttttgcc

SEQ ID NO: 6223 - DNA, 20 bp, Artificial Sequence
  Description of Artificial Sequence: Synthetic oligonucleotide
aactttactttccctttccc

SEQ ID NO: 6224 - DNA, 19 bp, Artificial Sequence
  Description of Artificial Sequence: Synthetic oligonucleotide
cttcttttctcgctttccg

SEQ ID NO: 6225 - DNA, 20 bp, Artificial Sequence
  Description of Artificial Sequence: Synthetic oligonucleotide
tatttttatttctttgtctg

SEQ ID NO: 6226 - DNA, 20 bp, Artificial Sequence
  Description of Artificial Sequence: Synthetic oligonucleotide
ttacttttaaattcgctctg

SEQ ID NO: 6227 - DNA, 20 bp, Artificial Sequence
  Description of Artificial Sequence: Synthetic oligonucleotide
tcctttacattttctttccg

SEQ ID NO: 6228 - DNA, 20 bp, Artificial Sequence
  Description of Artificial Sequence: Synthetic oligonucleotide
ctttagtttcattttttccg

SEQ ID NO: 6229 - DNA, 19 bp, Artificial Sequence
  Description of Artificial Sequence: Synthetic oligonucleotide
tttctgacacttttttccg

SEQ ID NO: 6230 - DNA, 20 bp, Artificial Sequence
  Description of Artificial Sequence: Synthetic oligonucleotide
tgcttaggaggatggaggtg

SEQ ID NO: 6231 - DNA, 20 bp, Artificial Sequence
  Description of Artificial Sequence: Synthetic oligonucleotide
tttcatgcccattctttccg

SEQ ID NO: 6232 - DNA, 20 bp, Artificial Sequence
  Description of Artificial Sequence: Synthetic oligonucleotide
gtgtctttctttcttttccc

SEQ ID NO: 6233 - DNA, 20 bp, Artificial Sequence
  Description of Artificial Sequence: Synthetic oligonucleotide
tcattttcttttttccccac

SEQ ID NO: 6234 - DNA, 20 bp, Artificial Sequence
  Description of Artificial Sequence: Synthetic oligonucleotide
agggattggaggtgtacccg

SEQ ID NO: 6235 - DNA, 21 bp, Artificial Sequence
  Description of Artificial Sequence: Synthetic oligonucleotide
tttattttcttctcatttcct

SEQ ID NO: 6236 - DNA, 19 bp, Artificial Sequence
  Description of Artificial Sequence: Synthetic oligonucleotide
atttctttcctttttaccg

SEQ ID NO: 6237 - DNA, 22 bp, Artificial Sequence
  Description of Artificial Sequence: Synthetic oligonucleotide
ctatccttgtttttttcttccg

SEQ ID NO: 6238 - DNA, 20 bp, Artificial Sequence
  Description of Artificial Sequence: Synthetic oligonucleotide
cttttttcccaccatttccg

SEQ ID NO: 6239 - DNA, 21 bp, Artificial Sequence
  Description of Artificial Sequence: Synthetic oligonucleotide
atcgctctatttttttctccg

SEQ ID NO: 6240 - DNA, 19 bp, Artificial Sequence
  Description of Artificial Sequence: Synthetic oligonucleotide
ctttcttcgctttttaccg

SEQ ID NO: 6241 - DNA, 20 bp, Artificial Sequence
  Description of Artificial Sequence: Synthetic oligonucleotide
ctatatcatttctctttccg

SEQ ID NO: 6242 - DNA, 20 bp, Artificial Sequence
  Description of Artificial Sequence: Synthetic oligonucleotide
ctttccaattcctttttccg

SEQ ID NO: 6243 - DNA, 20 bp, Artificial Sequence
  Description of Artificial Sequence: Synthetic oligonucleotide
aattcctttgtttcttaccg

SEQ ID NO: 6244 - DNA, 20 bp, Artificial Sequence
  Description of Artificial Sequence: Synthetic oligonucleotide
ccttttattttttttctccg

SEQ ID NO: 6245 - DNA, 20 bp, Artificial Sequence
  Description of Artificial Sequence: Synthetic oligonucleotide
cttacattaccctttttccg

SEQ ID NO: 6246 - DNA, 21 bp, Artificial Sequence
  Description of Artificial Sequence: Synthetic oligonucleotide
aacttgttttttttttaccgc

SEQ ID NO: 6247 - DNA, 20 bp, Artificial Sequence
  Description of Artificial Sequence: Synthetic oligonucleotide
ctacttactcttattctccg

SEQ ID NO: 6248 - DNA, 21 bp, Artificial Sequence
  Description of Artificial Sequence: Synthetic oligonucleotide
tcttttcacttactttttccg

SEQ ID NO: 6249 - DNA, 20 bp, Artificial Sequence
  Description of Artificial Sequence: Synthetic oligonucleotide
cttgtcacactctttttccg

SEQ ID NO: 6250 - DNA, 20 bp, Artificial Sequence
  Description of Artificial Sequence: Synthetic oligonucleotide
ccaattattcttttctaccg

SEQ ID NO: 6251 - DNA, 20 bp, Artificial Sequence
  Description of Artificial Sequence: Synthetic oligonucleotide
tctttctcttatttactccc

SEQ ID NO: 6252 - DNA, 21 bp, Artificial Sequence
  Description of Artificial Sequence: Synthetic oligonucleotide
attctttttttgttttttgcc

SEQ ID NO: 6253 - DNA, 20 bp, Artificial Sequence
  Description of Artificial Sequence: Synthetic oligonucleotide
cttcttctatatactctccg

SEQ ID NO: 6254 - DNA, 20 bp, Artificial Sequence
  Description of Artificial Sequence: Synthetic oligonucleotide
ctttctttattctctcttgc

SEQ ID NO: 6255 - DNA, 20 bp, Artificial Sequence
  Description of Artificial Sequence: Synthetic oligonucleotide
ttctattaacctttttcccg

SEQ ID NO: 6256 - DNA, 20 bp, Artificial Sequence
  Description of Artificial Sequence: Synthetic oligonucleotide
ctttttgttgctttattccg

SEQ ID NO: 6257 - DNA, 21 bp, Artificial Sequence
  Description of Artificial Sequence: Synthetic oligonucleotide
tttttaccctttttttgtcct

SEQ ID NO: 6258 - DNA, 21 bp, Artificial Sequence
  Description of Artificial Sequence: Synthetic oligonucleotide
atttttttctcttatttgccg

SEQ ID NO: 6259 - DNA, 22 bp, Artificial Sequence
  Description of Artificial Sequence: Synthetic oligonucleotide
tttttctcttttttttccgccg

SEQ ID NO: 6260 - DNA, 21 bp, Artificial Sequence
  Description of Artificial Sequence: Synthetic oligonucleotide
ttatttattttttttcgcccg

SEQ ID NO: 6261 - DNA, 21 bp, Artificial Sequence
  Description of Artificial Sequence: Synthetic oligonucleotide
gatattttctctttttttgcc

SEQ ID NO: 6262 - DNA, 20 bp, Artificial Sequence
  Description of Artificial Sequence: Synthetic oligonucleotide
ttcatttgttttttttcgtg

SEQ ID NO: 6263 - DNA, 22 bp, Artificial Sequence
  Description of Artificial Sequence: Synthetic oligonucleotide
atttcactgtctttttttcccg

SEQ ID NO: 6264 - DNA, 21 bp, Artificial Sequence
  Description of Artificial Sequence: Synthetic oligonucleotide
tctgttttacttttttttccc

SEQ ID NO: 6265 - DNA, 20 bp, Artificial Sequence
  Description of Artificial Sequence: Synthetic oligonucleotide
gctttttatcgttttttccg

SEQ ID NO: 6266 - DNA, 20 bp, Artificial Sequence
  Description of Artificial Sequence: Synthetic oligonucleotide
cttattactttttttttgcc

SEQ ID NO: 6267 - DNA, 21 bp, Artificial Sequence
  Description of Artificial Sequence: Synthetic oligonucleotide
tcttttttaactttttctccg

SEQ ID NO: 6268 - DNA, 20 bp, Artificial Sequence
  Description of Artificial Sequence: Synthetic oligonucleotide
acacttctctttttctaccg

SEQ ID NO: 6269 - DNA, 20 bp, Artificial Sequence
  Description of Artificial Sequence: Synthetic oligonucleotide
tcctgacgtctgttggtccc

SEQ ID NO: 6270 - DNA, 19 bp, Artificial Sequence
  Description of Artificial Sequence: Synthetic oligonucleotide
tcctgtcgtctgccctccc

SEQ ID NO: 6271 - DNA, 20 bp, Artificial Sequence
  Description of Artificial Sequence: Synthetic oligonucleotide
tccttgtcgtcttccgtccc

SEQ ID NO: 6272 - DNA, 20 bp, Artificial Sequence
  Description of Artificial Sequence: Synthetic oligonucleotide
tcctgtcgtctgctcgcccc

SEQ ID NO: 6273 - DNA, 20 bp, Artificial Sequence
  Description of Artificial Sequence: Synthetic oligonucleotide
tcctgtcggcggttcgtccc

SEQ ID NO: 6274 - DNA, 20 bp, Artificial Sequence
  Description of Artificial Sequence: Synthetic oligonucleotide
attcacttctcttcttgccg

SEQ ID NO: 6275 - DNA, 20 bp, Artificial Sequence
  Description of Artificial Sequence: Synthetic oligonucleotide
aattatgtgttttttgaccg

SEQ ID NO: 6276 - DNA, 20 bp, Artificial Sequence
  Description of Artificial Sequence: Synthetic oligonucleotide
tttgggagtagggtgttcct

SEQ ID NO: 6277 - DNA, 20 bp, Artificial Sequence
  Description of Artificial Sequence: Synthetic oligonucleotide
tatcttcttctttttctccg

SEQ ID NO: 6278 - DNA, 20 bp, Artificial Sequence
  Description of Artificial Sequence: Synthetic oligonucleotide
atttcttttccttttttccg

SEQ ID NO: 6279 - DNA, 21 bp, Artificial Sequence
  Description of Artificial Sequence: Synthetic oligonucleotide
tattccttgttctctttgccg

SEQ ID NO: 6280 - DNA, 19 bp, Artificial Sequence
  Description of Artificial Sequence: Synthetic oligonucleotide
actttcttctttcttgccg

SEQ ID NO: 6281 - DNA, 19 bp, Artificial Sequence
  Description of Artificial Sequence: Synthetic oligonucleotide
actttatcctgcaagtccc

SEQ ID NO: 6282 - DNA, 22 bp, Artificial Sequence
  Description of Artificial Sequence: Synthetic oligonucleotide
aattatgtgttttttgtgactg

SEQ ID NO: 6283 - DNA, 20 bp, Artificial Sequence
  Description of Artificial Sequence: Synthetic oligonucleotide
ttctcttgttgtttttgccc

SEQ ID NO: 6284 - DNA, 20 bp, Artificial Sequence
  Description of Artificial Sequence: Synthetic oligonucleotide
tctggggttttcactgtccg

SEQ ID NO: 6285 - DNA, 20 bp, Artificial Sequence
  Description of Artificial Sequence: Synthetic oligonucleotide
ttgggtgtagggaggttccg

SEQ ID NO: 6286 - DNA, 20 bp, Artificial Sequence
  Description of Artificial Sequence: Synthetic oligonucleotide
aagggtgtagggtggtaccg

SEQ ID NO: 6287 - DNA, 20 bp, Artificial Sequence
  Description of Artificial Sequence: Synthetic oligonucleotide
atttcctttcctttttaccg

SEQ ID NO: 6288 - DNA, 20 bp, Artificial Sequence
  Description of Artificial Sequence: Synthetic oligonucleotide
ttcttttccttctttctccg

SEQ ID NO: 6289 - DNA, 18 bp, Artificial Sequence
  Description of Artificial Sequence: Synthetic oligonucleotide
cctttcgttctgcctccc

SEQ ID NO: 6290 - DNA, 20 bp, Artificial Sequence
  Description of Artificial Sequence: Synthetic oligonucleotide
tcctgttattctcttctccg

SEQ ID NO: 6291 - DNA, 20 bp, Artificial Sequence
  Description of Artificial Sequence: Synthetic oligonucleotide
ttttattattctctgctgcc

SEQ ID NO: 6292 - DNA, 20 bp, Artificial Sequence
  Description of Artificial Sequence: Synthetic oligonucleotide
tttgttttatcttttgtccc

SEQ ID NO: 6293 - DNA, 19 bp, Artificial Sequence
  Description of Artificial Sequence: Synthetic oligonucleotide
ccttttctttcctattccg

SEQ ID NO: 6294 - DNA, 20 bp, Artificial Sequence
  Description of Artificial Sequence: Synthetic oligonucleotide
ctactcttttcttacctccg

SEQ ID NO: 6295 - DNA, 20 bp, Artificial Sequence
  Description of Artificial Sequence: Synthetic oligonucleotide
ttttactattcactttccgc

SEQ ID NO: 6296 - DNA, 20 bp, Artificial Sequence
  Description of Artificial Sequence: Synthetic oligonucleotide
tccagtttctattttctccg

SEQ ID NO: 6297 - DNA, 18 bp, Artificial Sequence
  Description of Artificial Sequence: Synthetic oligonucleotide
attttctcttttttgccg

SEQ ID NO: 6298 - DNA, 20 bp, Artificial Sequence
  Description of Artificial Sequence: Synthetic oligonucleotide
tatcattattatttcctccg

SEQ ID NO: 6299 - DNA, 20 bp, Artificial Sequence
  Description of Artificial Sequence: Synthetic oligonucleotide
tcttttcatgtttttctccg

SEQ ID NO: 6300 - DNA, 20 bp, Artificial Sequence
  Description of Artificial Sequence: Synthetic oligonucleotide
acatctcactttctctaccg

SEQ ID NO: 6301 - DNA, 20 bp, Artificial Sequence
  Description of Artificial Sequence: Synthetic oligonucleotide
atcattttcctacttctccg

SEQ ID NO: 6302 - DNA, 19 bp, Artificial Sequence
  Description of Artificial Sequence: Synthetic oligonucleotide
gcctttcgttctgcttccc

SEQ ID NO: 6303 - DNA, 20 bp, Artificial Sequence
  Description of Artificial Sequence: Synthetic oligonucleotide
ccttatctctactctttccg

SEQ ID NO: 6304 - DNA, 18 bp, Artificial Sequence
  Description of Artificial Sequence: Synthetic oligonucleotide
gcctttcgttctcccccc

SEQ ID NO: 6305 - DNA, 19 bp, Artificial Sequence
  Description of Artificial Sequence: Synthetic oligonucleotide
gcattcgttctgccctccc

SEQ ID NO: 6306 - DNA, 21 bp, Artificial Sequence
  Description of Artificial Sequence: Synthetic oligonucleotide
attactcttctctttttgccg

SEQ ID NO: 6307 - DNA, 20 bp, Artificial Sequence
  Description of Artificial Sequence: Synthetic oligonucleotide
ttcattttctttcctctccg

SEQ ID NO: 6308 - DNA, 21 bp, Artificial Sequence
  Description of Artificial Sequence: Synthetic oligonucleotide
tttacttctttccacgttccg

SEQ ID NO: 6309 - DNA, 20 bp, Artificial Sequence
  Description of Artificial Sequence: Synthetic oligonucleotide
tgttttgtttgctttatccc

SEQ ID NO: 6310 - DNA, 20 bp, Artificial Sequence
  Description of Artificial Sequence: Synthetic oligonucleotide
gttttccttcttttcgcccg

SEQ ID NO: 6311 - DNA, 20 bp, Artificial Sequence
  Description of Artificial Sequence: Synthetic oligonucleotide
cttttctcttcattttaccg

SEQ ID NO: 6312 - DNA, 20 bp, Artificial Sequence
  Description of Artificial Sequence: Synthetic oligonucleotide
ccttattactaccttttccg

SEQ ID NO: 6313 - DNA, 20 bp, Artificial Sequence
  Description of Artificial Sequence: Synthetic oligonucleotide
tttattactacttcgttccg

SEQ ID NO: 6314 - DNA, 19 bp, Artificial Sequence
  Description of Artificial Sequence: Synthetic oligonucleotide
ttttttgattttgtttccg

SEQ ID NO: 6315 - DNA, 20 bp, Artificial Sequence
  Description of Artificial Sequence: Synthetic oligonucleotide
tacttgttctactttctccg

SEQ ID NO: 6316 - DNA, 20 bp, Artificial Sequence
  Description of Artificial Sequence: Synthetic oligonucleotide
attcttgcttatattcaccg

SEQ ID NO: 6317 - DNA, 20 bp, Artificial Sequence
  Description of Artificial Sequence: Synthetic oligonucleotide
cttactctttttattcaccg

SEQ ID NO: 6318 - DNA, 20 bp, Artificial Sequence
  Description of Artificial Sequence: Synthetic oligonucleotide
cctttctcttgtttcttgcc

SEQ ID NO: 6319 - DNA, 20 bp, Artificial Sequence
  Description of Artificial Sequence: Synthetic oligonucleotide
gattcttactcttatttccc

SEQ ID NO: 6320 - DNA, 20 bp, Artificial Sequence
  Description of Artificial Sequence: Synthetic oligonucleotide
gcctttcggtcttccctccc

SEQ ID NO: 6321 - DNA, 20 bp, Artificial Sequence
  Description of Artificial Sequence: Synthetic oligonucleotide
attacttctatttcttaccc

SEQ ID NO: 6322 - DNA, 19 bp, Artificial Sequence
  Description of Artificial Sequence: Synthetic oligonucleotide
acttttttcttttctaccg

SEQ ID NO: 6323 - DNA, 20 bp, Artificial Sequence
  Description of Artificial Sequence: Synthetic oligonucleotide
ccatttttgttccttttccg

SEQ ID NO: 6324 - DNA, 21 bp, Artificial Sequence
  Description of Artificial Sequence: Synthetic oligonucleotide
tttccgggtttttttttgccg

SEQ ID NO: 6325 - DNA, 18 bp, Artificial Sequence
  Description of Artificial Sequence: Synthetic oligonucleotide
cttttctctctttttccg

SEQ ID NO: 6326 - DNA, 20 bp, Artificial Sequence
  Description of Artificial Sequence: Synthetic oligonucleotide
tcctttcgttctgttctccc

SEQ ID NO: 6327 - DNA, 21 bp, Artificial Sequence
  Description of Artificial Sequence: Synthetic oligonucleotide
cgttattttctccttggtcgc

SEQ ID NO: 6328 - DNA, 20 bp, Artificial Sequence
  Description of Artificial Sequence: Synthetic oligonucleotide
ctcattttctctcctttccg

SEQ ID NO: 6329 - DNA, 20 bp, Artificial Sequence
  Description of Artificial Sequence: Synthetic oligonucleotide
ttatttttcacttctcacgc

SEQ ID NO: 6330 - DNA, 20 bp, Artificial Sequence
  Description of Artificial Sequence: Synthetic oligonucleotide
atattcgttatttttgtgcc

SEQ ID NO: 6331 - DNA, 20 bp, Artificial Sequence
  Description of Artificial Sequence: Synthetic oligonucleotide
tatcttttgtttttcctcgc

SEQ ID NO: 6332 - DNA, 20 bp, Artificial Sequence
  Description of Artificial Sequence: Synthetic oligonucleotide
cttcttgcagtctttttccg

SEQ ID NO: 6333 - DNA, 20 bp, Artificial Sequence
  Description of Artificial Sequence: Synthetic oligonucleotide
tctcttcatgtttctctccg

SEQ ID NO: 6334 - DNA, 20 bp, Artificial Sequence
  Description of Artificial Sequence: Synthetic oligonucleotide
tttgaagggcgataggtccg

SEQ ID NO: 6335 - DNA, 20 bp, Artificial Sequence
  Description of Artificial Sequence: Synthetic oligonucleotide
cctttactgtttcgcttccg

SEQ ID NO: 6336 - DNA, 20 bp, Artificial Sequence
  Description of Artificial Sequence: Synthetic oligonucleotide
tctctgttgtatttcctccg

SEQ ID NO: 6337 - DNA, 19 bp, Artificial Sequence
  Description of Artificial Sequence: Synthetic oligonucleotide
attctctttctttttaccg

SEQ ID NO: 6338 - DNA, 21 bp, Artificial Sequence
  Description of Artificial Sequence: Synthetic oligonucleotide
tactttttttccctttgcgtg

SEQ ID NO: 6339 - DNA, 18 bp, Artificial Sequence
  Description of Artificial Sequence: Synthetic oligonucleotide
ttttttttcttgtttccg

SEQ ID NO: 6340 - DNA, 20 bp, Artificial Sequence
  Description of Artificial Sequence: Synthetic oligonucleotide
atttttgacttctttacccg

SEQ ID NO: 6341 - DNA, 20 bp, Artificial Sequence
  Description of Artificial Sequence: Synthetic oligonucleotide
tttattttcttcttttgcac

SEQ ID NO: 6342 - DNA, 20 bp, Artificial Sequence
  Description of Artificial Sequence: Synthetic oligonucleotide
ctattttattgttttctctg

SEQ ID NO: 6343 - DNA, 20 bp, Artificial Sequence
  Description of Artificial Sequence: Synthetic oligonucleotide
ttatcctgactccgtacgtc

SEQ ID NO: 6344 - DNA, 20 bp, Artificial Sequence
  Description of Artificial Sequence: Synthetic oligonucleotide
tctttatttcatttccgccg

SEQ ID NO: 6345 - DNA, 20 bp, Artificial Sequence
  Description of Artificial Sequence: Synthetic oligonucleotide
catgctttactttttttccg

SEQ ID NO: 6346 - DNA, 20 bp, Artificial Sequence
  Description of Artificial Sequence: Synthetic oligonucleotide
atacgctcttatttttgccg

SEQ ID NO: 6347 - DNA, 19 bp, Artificial Sequence
  Description of Artificial Sequence: Synthetic oligonucleotide
tctttaattttgctccccg

SEQ ID NO: 6348 - DNA, 19 bp, Artificial Sequence
  Description of Artificial Sequence: Synthetic oligonucleotide
ttagtttttattttgtttg

SEQ ID NO: 6349 - DNA, 22 bp, Artificial Sequence
  Description of Artificial Sequence: Synthetic oligonucleotide
tttgaactcttttttttttccg

SEQ ID NO: 6350 - DNA, 20 bp, Artificial Sequence
  Description of Artificial Sequence: Synthetic oligonucleotide
tttttcttctattcgctcca

SEQ ID NO: 6351 - DNA, 20 bp, Artificial Sequence
  Description of Artificial Sequence: Synthetic oligonucleotide
attttgataattttgctctg

SEQ ID NO: 6352 - DNA, 20 bp, Artificial Sequence
  Description of Artificial Sequence: Synthetic oligonucleotide
attctgttgttttcctaccg

SEQ ID NO: 6353 - DNA, 20 bp, Artificial Sequence
  Description of Artificial Sequence: Synthetic oligonucleotide
tttattgtatttttccttgg

SEQ ID NO: 6354 - DNA, 20 bp, Artificial Sequence
  Description of Artificial Sequence: Synthetic oligonucleotide
cttatttacggtttcttccg

SEQ ID NO: 6355 - DNA, 20 bp, Artificial Sequence
  Description of Artificial Sequence: Synthetic oligonucleotide
ctctacctttttatcttccg

SEQ ID NO: 6356 - DNA, 20 bp, Artificial Sequence
  Description of Artificial Sequence: Synthetic oligonucleotide
ttcttttctctgttcacccg

SEQ ID NO: 6357 - DNA, 21 bp, Artificial Sequence
  Description of Artificial Sequence: Synthetic oligonucleotide
attttttaactttacgctccc

SEQ ID NO: 6358 - DNA, 20 bp, Artificial Sequence
  Description of Artificial Sequence: Synthetic oligonucleotide
ctttctgtcttttactaccg

SEQ ID NO: 6359 - DNA, 21 bp, Artificial Sequence
  Description of Artificial Sequence: Synthetic oligonucleotide
tcactttttttttctaccccg

SEQ ID NO: 6360 - DNA, 20 bp, Artificial Sequence
  Description of Artificial Sequence: Synthetic oligonucleotide
tactattttcttcacttgcc

SEQ ID NO: 6361 - DNA, 20 bp, Artificial Sequence
  Description of Artificial Sequence: Synthetic oligonucleotide
tactttttctttccttacgc

SEQ ID NO: 6362 - DNA, 20 bp, Artificial Sequence
  Description of Artificial Sequence: Synthetic oligonucleotide
accacttttatcctattccg

SEQ ID NO: 6363 - DNA, 20 bp, Artificial Sequence
  Description of Artificial Sequence: Synthetic oligonucleotide
acttaacttttctctacccg

SEQ ID NO: 6364 - DNA, 20 bp, Artificial Sequence
  Description of Artificial Sequence: Synthetic oligonucleotide
ttctttcttctttttctccg

SEQ ID NO: 6365 - DNA, 20 bp, Artificial Sequence
  Description of Artificial Sequence: Synthetic oligonucleotide
atttcctttatctcataccg

SEQ ID NO: 6366 - DNA, 20 bp, Artificial Sequence
  Description of Artificial Sequence: Synthetic oligonucleotide
cattttactttccttctccg

SEQ ID NO: 6367 - DNA, 20 bp, Artificial Sequence
  Description of Artificial Sequence: Synthetic oligonucleotide
cttcatctttgctcttaccg

SEQ ID NO: 6368 - DNA, 20 bp, Artificial Sequence
  Description of Artificial Sequence: Synthetic oligonucleotide
tttccacaacttctcttccg

SEQ ID NO: 6369 - DNA, 20 bp, Artificial Sequence
  Description of Artificial Sequence: Synthetic oligonucleotide
gtttaatttatgcttttccg

SEQ ID NO: 6370 - DNA, 20 bp, Artificial Sequence
  Description of Artificial Sequence: Synthetic oligonucleotide
tgttactcactttctttccg

SEQ ID NO: 6371 - DNA, 21 bp, Artificial Sequence
  Description of Artificial Sequence: Synthetic oligonucleotide
tttcttttacgtttttttccc

SEQ ID NO: 6372 - DNA, 21 bp, Artificial Sequence
  Description of Artificial Sequence: Synthetic oligonucleotide
tttttcagtgttttttgtgtg

SEQ ID NO: 6373 - DNA, 19 bp, Artificial Sequence
  Description of Artificial Sequence: Synthetic oligonucleotide
tttttcgatctttgttccg

SEQ ID NO: 6374 - DNA, 20 bp, Artificial Sequence
  Description of Artificial Sequence: Synthetic oligonucleotide
ttattctctttcatcttccg

SEQ ID NO: 6375 - DNA, 20 bp, Artificial Sequence
  Description of Artificial Sequence: Synthetic oligonucleotide
ttacctttctttttactccg

SEQ ID NO: 6376 - DNA, 20 bp, Artificial Sequence
  Description of Artificial Sequence: Synthetic oligonucleotide
ctttgtcaactgtttttccg

SEQ ID NO: 6377 - DNA, 20 bp, Artificial Sequence
  Description of Artificial Sequence: Synthetic oligonucleotide
ttctttagtcactttttccc

SEQ ID NO: 6378 - DNA, 20 bp, Artificial Sequence
  Description of Artificial Sequence: Synthetic oligonucleotide
ctctactttcttaccttccg

SEQ ID NO: 6379 - DNA, 20 bp, Artificial Sequence
  Description of Artificial Sequence: Synthetic oligonucleotide
tttctcttttctctgcccgc

SEQ ID NO: 6380 - DNA, 19 bp, Artificial Sequence
  Description of Artificial Sequence: Synthetic oligonucleotide
tttttcttttccttgtccg

SEQ ID NO: 6381 - DNA, 20 bp, Artificial Sequence
  Description of Artificial Sequence: Synthetic oligonucleotide
ttttattctaactttccctg

SEQ ID NO: 6382 - DNA, 20 bp, Artificial Sequence
  Description of Artificial Sequence: Synthetic oligonucleotide
ttgtttcctcttcttttccg

SEQ ID NO: 6383 - DNA, 20 bp, Artificial Sequence
  Description of Artificial Sequence: Synthetic oligonucleotide
attcttttcttctctctcgc

SEQ ID NO: 6384 - DNA, 20 bp, Artificial Sequence
  Description of Artificial Sequence: Synthetic oligonucleotide
actctttcttctcttttccg

SEQ ID NO: 6385 - DNA, 20 bp, Artificial Sequence
  Description of Artificial Sequence: Synthetic oligonucleotide
tttggagggtgatggggccg

SEQ ID NO: 6386 - DNA, 21 bp, Artificial Sequence
  Description of Artificial Sequence: Synthetic oligonucleotide
tttttcacttttttcgcccct

SEQ ID NO: 6387 - DNA, 20 bp, Artificial Sequence
  Description of Artificial Sequence: Synthetic oligonucleotide
tttttctactttcctttccg

SEQ ID NO: 6388 - DNA, 20 bp, Artificial Sequence
  Description of Artificial Sequence: Synthetic oligonucleotide
ctgtttcattcttttttccc

SEQ ID NO: 6389 - DNA, 20 bp, Artificial Sequence
  Description of Artificial Sequence: Synthetic oligonucleotide
tttattcttattcttttgcg

SEQ ID NO: 6390 - DNA, 20 bp, Artificial Sequence
  Description of Artificial Sequence: Synthetic oligonucleotide
gccttttctcctttctaccg

SEQ ID NO: 6391 - DNA, 20 bp, Artificial Sequence
  Description of Artificial Sequence: Synthetic oligonucleotide
tttcctgtttgttttctgcg

SEQ ID NO: 6392 - DNA, 20 bp, Artificial Sequence
  Description of Artificial Sequence: Synthetic oligonucleotide
tttttcggacttttctcccg

SEQ ID NO: 6393 - DNA, 20 bp, Artificial Sequence
  Description of Artificial Sequence: Synthetic oligonucleotide
ttttatttctacttctttgc

SEQ ID NO: 6394 - DNA, 20 bp, Artificial Sequence
  Description of Artificial Sequence: Synthetic oligonucleotide
tttgtttattctcttttccg

SEQ ID NO: 6395 - DNA, 20 bp, Artificial Sequence
  Description of Artificial Sequence: Synthetic oligonucleotide
ttctttctatctcttctccg

SEQ ID NO: 6396 - DNA, 20 bp, Artificial Sequence
  Description of Artificial Sequence: Synthetic oligonucleotide
ctttttacctttcctttctg

SEQ ID NO: 6397 - DNA, 22 bp, Artificial Sequence
  Description of Artificial Sequence: Synthetic oligonucleotide
tttctttcattttttttttccg

SEQ ID NO: 6398 - DNA, 20 bp, Artificial Sequence
  Description of Artificial Sequence: Synthetic oligonucleotide
ttcacttactactttttctg

SEQ ID NO: 6399 - DNA, 20 bp, Artificial Sequence
  Description of Artificial Sequence: Synthetic oligonucleotide
gtcttctttttcttgtaccg

SEQ ID NO: 6400 - DNA, 19 bp, Artificial Sequence
  Description of Artificial Sequence: Synthetic oligonucleotide
ccttttacttttttttccg

SEQ ID NO: 6401 - DNA, 20 bp, Artificial Sequence
  Description of Artificial Sequence: Synthetic oligonucleotide
atttccaacttttctttccg

SEQ ID NO: 6402 - DNA, 22 bp, Artificial Sequence
  Description of Artificial Sequence: Synthetic oligonucleotide
ttttagctcctttttttgtccg

SEQ ID NO: 6403 - DNA, 20 bp, Artificial Sequence
  Description of Artificial Sequence: Synthetic oligonucleotide
ttttcaatatcacttttcgc

SEQ ID NO: 6404 - DNA, 21 bp, Artificial Sequence
  Description of Artificial Sequence: Synthetic oligonucleotide
actttttgttactttttaccc

SEQ ID NO: 6405 - DNA, 20 bp, Artificial Sequence
  Description of Artificial Sequence: Synthetic oligonucleotide
tttatcttttacctgttccc

SEQ ID NO: 6406 - DNA, 20 bp, Artificial Sequence
  Description of Artificial Sequence: Synthetic oligonucleotide
attctcaatttatttccccg

SEQ ID NO: 6407 - DNA, 19 bp, Artificial Sequence
  Description of Artificial Sequence: Synthetic oligonucleotide
ctttctttctctttttccg

SEQ ID NO: 6408 - DNA, 19 bp, Artificial Sequence
  Description of Artificial Sequence: Synthetic oligonucleotide
ttttctactttcttttccg

SEQ ID NO: 6409 - DNA, 20 bp, Artificial Sequence
  Description of Artificial Sequence: Synthetic oligonucleotide
ttttctattattcctttccg

SEQ ID NO: 6410 - DNA, 20 bp, Artificial Sequence
  Description of Artificial Sequence: Synthetic oligonucleotide
ctttattctttactttactg

SEQ ID NO: 6411 - DNA, 20 bp, Artificial Sequence
  Description of Artificial Sequence: Synthetic oligonucleotide
tttggtgttttcccgtgccc

SEQ ID NO: 6412 - DNA, 20 bp, Artificial Sequence
  Description of Artificial Sequence: Synthetic oligonucleotide
tctcatgttcctcctgtgcc

SEQ ID NO: 6413 - DNA, 20 bp, Artificial Sequence
  Description of Artificial Sequence: Synthetic oligonucleotide
tcctttcgtcttttcgtccc

SEQ ID NO: 6414 - DNA, 20 bp, Artificial Sequence
  Description of Artificial Sequence: Synthetic oligonucleotide
tcctgtcgtctttgtgtccc

SEQ ID NO: 6415 - DNA, 20 bp, Artificial Sequence
  Description of Artificial Sequence: Synthetic oligonucleotide
tccttgtcgtcttgcttccc

SEQ ID NO: 6416 - DNA, 20 bp, Artificial Sequence
  Description of Artificial Sequence: Synthetic oligonucleotide
attcttctattttctctccg

SEQ ID NO: 6417 - DNA, 20 bp, Artificial Sequence
  Description of Artificial Sequence: Synthetic oligonucleotide
tccttgtcgtcttgcctccc

SEQ ID NO: 6418 - DNA, 19 bp, Artificial Sequence
  Description of Artificial Sequence: Synthetic oligonucleotide
cctttcgttctaccctccc

SEQ ID NO: 6419 - DNA, 20 bp, Artificial Sequence
  Description of Artificial Sequence: Synthetic oligonucleotide
atgcttggaggagggaggtg

SEQ ID NO: 6420 - DNA, 20 bp, Artificial Sequence
  Description of Artificial Sequence: Synthetic oligonucleotide
tcctgtcgtctttacgtccc

SEQ ID NO: 6421 - DNA, 20 bp, Artificial Sequence
  Description of Artificial Sequence: Synthetic oligonucleotide
tgagtcgttcccttcgttcc

SEQ ID NO: 6422 - DNA, 20 bp, Artificial Sequence
  Description of Artificial Sequence: Synthetic oligonucleotide
atacttctaccttttctccg

SEQ ID NO: 6423 - DNA, 19 bp, Artificial Sequence
  Description of Artificial Sequence: Synthetic oligonucleotide
cgtttctctggttcgtccc

SEQ ID NO: 6424 - DNA, 20 bp, Artificial Sequence
  Description of Artificial Sequence: Synthetic oligonucleotide
tcctgtcgtcctttcgtccc

SEQ ID NO: 6425 - DNA, 19 bp, Artificial Sequence
  Description of Artificial Sequence: Synthetic oligonucleotide
gttggtgtagggggttccg

SEQ ID NO: 6426 - DNA, 20 bp, Artificial Sequence
  Description of Artificial Sequence: Synthetic oligonucleotide
tttcctcttgtttttgtccc

SEQ ID NO: 6427 - DNA, 20 bp, Artificial Sequence
  Description of Artificial Sequence: Synthetic oligonucleotide
acttcttacctttttctccg

SEQ ID NO: 6428 - DNA, 20 bp, Artificial Sequence
  Description of Artificial Sequence: Synthetic oligonucleotide
ggcttctctctttacttccc

SEQ ID NO: 6429 - DNA, 20 bp, Artificial Sequence
  Description of Artificial Sequence: Synthetic oligonucleotide
cctgtttattttttgccccc

SEQ ID NO: 6430 - DNA, 20 bp, Artificial Sequence
  Description of Artificial Sequence: Synthetic oligonucleotide
tccagctttctttttctccg

SEQ ID NO: 6431 - DNA, 18 bp, Artificial Sequence
  Description of Artificial Sequence: Synthetic oligonucleotide
tcttttgctttctttccg

SEQ ID NO: 6432 - DNA, 20 bp, Artificial Sequence
  Description of Artificial Sequence: Synthetic oligonucleotide
ctatttcttcttgccctccg

SEQ ID NO: 6433 - DNA, 20 bp, Artificial Sequence
  Description of Artificial Sequence: Synthetic oligonucleotide
tttgaagggagatgggtcct

SEQ ID NO: 6434 - DNA, 20 bp, Artificial Sequence
  Description of Artificial Sequence: Synthetic oligonucleotide
cttatggagtagggcggtgc

SEQ ID NO: 6435 - DNA, 20 bp, Artificial Sequence
  Description of Artificial Sequence: Synthetic oligonucleotide
atgcttggagtagggagggg

SEQ ID NO: 6436 - DNA, 20 bp, Artificial Sequence
  Description of Artificial Sequence: Synthetic oligonucleotide
tcatctttgtcttctttccg

SEQ ID NO: 6437 - DNA, 20 bp, Artificial Sequence
  Description of Artificial Sequence: Synthetic oligonucleotide
agtttcgtctctttgttccg

SEQ ID NO: 6438 - DNA, 18 bp, Artificial Sequence
  Description of Artificial Sequence: Synthetic oligonucleotide
ttcatttcttcttctccg

SEQ ID NO: 6439 - DNA, 20 bp, Artificial Sequence
  Description of Artificial Sequence: Synthetic oligonucleotide
ctttatccttttctcctccg

SEQ ID NO: 6440 - DNA, 19 bp, Artificial Sequence
  Description of Artificial Sequence: Synthetic oligonucleotide
cctttttctttttctaccg

SEQ ID NO: 6441 - DNA, 20 bp, Artificial Sequence
  Description of Artificial Sequence: Synthetic oligonucleotide
tctattcttcttttctccgc

SEQ ID NO: 6442 - DNA, 21 bp, Artificial Sequence
  Description of Artificial Sequence: Synthetic oligonucleotide
atttttctcttttgcttgccg

SEQ ID NO: 6443 - DNA, 20 bp, Artificial Sequence
  Description of Artificial Sequence: Synthetic oligonucleotide
ctttttaaccaccttttccg

SEQ ID NO: 6444 - DNA, 20 bp, Artificial Sequence
  Description of Artificial Sequence: Synthetic oligonucleotide
gttactttcctttcctaccg

SEQ ID NO: 6445 - DNA, 21 bp, Artificial Sequence
  Description of Artificial Sequence: Synthetic oligonucleotide
taatttctattttccgctccg

SEQ ID NO: 6446 - DNA, 19 bp, Artificial Sequence
  Description of Artificial Sequence: Synthetic oligonucleotide
attctttctcttttcaccg

SEQ ID NO: 6447 - DNA, 19 bp, Artificial Sequence
  Description of Artificial Sequence: Synthetic oligonucleotide
tctttttgtttcttatccg

SEQ ID NO: 6448 - DNA, 20 bp, Artificial Sequence
  Description of Artificial Sequence: Synthetic oligonucleotide
cttatggagtaggggggtgc

SEQ ID NO: 6449 - DNA, 20 bp, Artificial Sequence
  Description of Artificial Sequence: Synthetic oligonucleotide
gtcgaagggtgatgggtccg

SEQ ID NO: 6450 - DNA, 20 bp, Artificial Sequence
  Description of Artificial Sequence: Synthetic oligonucleotide
tatgggagtagggtgttccg

SEQ ID NO: 6451 - DNA, 20 bp, Artificial Sequence
  Description of Artificial Sequence: Synthetic oligonucleotide
tttgaagggttatgggtccc

SEQ ID NO: 6452 - DNA, 20 bp, Artificial Sequence
  Description of Artificial Sequence: Synthetic oligonucleotide
tttccttgttttactgcccg

SEQ ID NO: 6453 - DNA, 20 bp, Artificial Sequence
  Description of Artificial Sequence: Synthetic oligonucleotide
ttatttcatttccttctgcc

SEQ ID NO: 6454 - DNA, 20 bp, Artificial Sequence
  Description of Artificial Sequence: Synthetic oligonucleotide
tctattatccttcttttccg

SEQ ID NO: 6455 - DNA, 22 bp, Artificial Sequence
  Description of Artificial Sequence: Synthetic oligonucleotide
aatctaccttttttttcctccg

SEQ ID NO: 6456 - DNA, 20 bp, Artificial Sequence
  Description of Artificial Sequence: Synthetic oligonucleotide
ttcgtttaactctttttccg

SEQ ID NO: 6457 - DNA, 20 bp, Artificial Sequence
  Description of Artificial Sequence: Synthetic oligonucleotide
tttcatatgctttttccctg

SEQ ID NO: 6458 - DNA, 20 bp, Artificial Sequence
  Description of Artificial Sequence: Synthetic oligonucleotide
attcgctcatctttttgccg

SEQ ID NO: 6459 - DNA, 20 bp, Artificial Sequence
  Description of Artificial Sequence: Synthetic oligonucleotide
ttccgctatactttcttccg

SEQ ID NO: 6460 - DNA, 21 bp, Artificial Sequence
  Description of Artificial Sequence: Synthetic oligonucleotide
tgttaggtctttttttttccg

SEQ ID NO: 6461 - DNA, 20 bp, Artificial Sequence
  Description of Artificial Sequence: Synthetic oligonucleotide
tttatttctcctgttttccc

SEQ ID NO: 6462 - DNA, 20 bp, Artificial Sequence
  Description of Artificial Sequence: Synthetic oligonucleotide
aatcctttttcttctatccg

SEQ ID NO: 6463 - DNA, 20 bp, Artificial Sequence
  Description of Artificial Sequence: Synthetic oligonucleotide
aatttttcgctttgttaccg

SEQ ID NO: 6464 - DNA, 20 bp, Artificial Sequence
  Description of Artificial Sequence: Synthetic oligonucleotide
tcttatttatgccttatccg

SEQ ID NO: 6465 - DNA, 20 bp, Artificial Sequence
  Description of Artificial Sequence: Synthetic oligonucleotide
ttcgctacattttttatccc

SEQ ID NO: 6466 - DNA, 20 bp, Artificial Sequence
  Description of Artificial Sequence: Synthetic oligonucleotide
tacattcttattttcttcgc

SEQ ID NO: 6467 - DNA, 20 bp, Artificial Sequence
  Description of Artificial Sequence: Synthetic oligonucleotide
tctttagcttttcccatccg

SEQ ID NO: 6468 - DNA, 20 bp, Artificial Sequence
  Description of Artificial Sequence: Synthetic oligonucleotide
tttccttttattttccccac

SEQ ID NO: 6469 - DNA, 20 bp, Artificial Sequence
  Description of Artificial Sequence: Synthetic oligonucleotide
atatcactttcctttcgccg

SEQ ID NO: 6470 - DNA, 20 bp, Artificial Sequence
  Description of Artificial Sequence: Synthetic oligonucleotide
tttctcttttcctttgtccg

SEQ ID NO: 6471 - DNA, 20 bp, Artificial Sequence
  Description of Artificial Sequence: Synthetic oligonucleotide
tcccattttgtctttttccg

SEQ ID NO: 6472 - DNA, 21 bp, Artificial Sequence
  Description of Artificial Sequence: Synthetic oligonucleotide
ttttttgttccattttatccg

SEQ ID NO: 6473 - DNA, 19 bp, Artificial Sequence
  Description of Artificial Sequence: Synthetic oligonucleotide
atattttgtttttttgccc

SEQ ID NO: 6474 - DNA, 20 bp, Artificial Sequence
  Description of Artificial Sequence: Synthetic oligonucleotide
cttatatttcactgtttccg

SEQ ID NO: 6475 - DNA, 20 bp, Artificial Sequence
  Description of Artificial Sequence: Synthetic oligonucleotide
tttgtttttctctttttccc

SEQ ID NO: 6476 - DNA, 21 bp, Artificial Sequence
  Description of Artificial Sequence: Synthetic oligonucleotide
ccatttgttttttttcctccg

SEQ ID NO: 6477 - DNA, 21 bp, Artificial Sequence
  Description of Artificial Sequence: Synthetic oligonucleotide
gaactcttttttttttcgccc

SEQ ID NO: 6478 - DNA, 20 bp, Artificial Sequence
  Description of Artificial Sequence: Synthetic oligonucleotide
ccatttgtttttttcttccg

SEQ ID NO: 6479 - DNA, 19 bp, Artificial Sequence
  Description of Artificial Sequence: Synthetic oligonucleotide
ttgaagggtgttgggtccg

SEQ ID NO: 6480 - DNA, 20 bp, Artificial Sequence
  Description of Artificial Sequence: Synthetic oligonucleotide
ttcactaacatttctttccg

SEQ ID NO: 6481 - DNA, 20 bp, Artificial Sequence
  Description of Artificial Sequence: Synthetic oligonucleotide
cttttaatgatgcttttccg

SEQ ID NO: 6482 - DNA, 21 bp, Artificial Sequence
  Description of Artificial Sequence: Synthetic oligonucleotide
attttttgtattcttttgccc

SEQ ID NO: 6483 - DNA, 20 bp, Artificial Sequence
  Description of Artificial Sequence: Synthetic oligonucleotide
cgttgttaatgttttttgcc

SEQ ID NO: 6484 - DNA, 20 bp, Artificial Sequence
  Description of Artificial Sequence: Synthetic oligonucleotide
ctttcttcgtttctttcccg

SEQ ID NO: 6485 - DNA, 20 bp, Artificial Sequence
  Description of Artificial Sequence: Synthetic oligonucleotide
atatttcattctttctaccc

SEQ ID NO: 6486 - DNA, 20 bp, Artificial Sequence
  Description of Artificial Sequence: Synthetic oligonucleotide
attttcatgtttcgttcccg

SEQ ID NO: 6487 - DNA, 20 bp, Artificial Sequence
  Description of Artificial Sequence: Synthetic oligonucleotide
gtttttttctattgtttccg

SEQ ID NO: 6488 - DNA, 20 bp, Artificial Sequence
  Description of Artificial Sequence: Synthetic oligonucleotide
ctttttctattcccataccg

SEQ ID NO: 6489 - DNA, 20 bp, Artificial Sequence
  Description of Artificial Sequence: Synthetic oligonucleotide
tttttgtctcttatttcctg

SEQ ID NO: 6490 - DNA, 20 bp, Artificial Sequence
  Description of Artificial Sequence: Synthetic oligonucleotide
tttattcattttcttgtcgc

SEQ ID NO: 6491 - DNA, 21 bp, Artificial Sequence
  Description of Artificial Sequence: Synthetic oligonucleotide
cacttttttatctttaccccc

SEQ ID NO: 6492 - DNA, 18 bp, Artificial Sequence
  Description of Artificial Sequence: Synthetic oligonucleotide
tttttcttcttttttccg

SEQ ID NO: 6493 - DNA, 20 bp, Artificial Sequence
  Description of Artificial Sequence: Synthetic oligonucleotide
atcttggtttttatttcccg

SEQ ID NO: 6494 - DNA, 20 bp, Artificial Sequence
  Description of Artificial Sequence: Synthetic oligonucleotide
catctactctttactctccg

SEQ ID NO: 6495 - DNA, 20 bp, Artificial Sequence
  Description of Artificial Sequence: Synthetic oligonucleotide
acttcgtttcactttcaccg

SEQ ID NO: 6496 - DNA, 20 bp, Artificial Sequence
  Description of Artificial Sequence: Synthetic oligonucleotide
ttttctaccagctttctccg

SEQ ID NO: 6497 - DNA, 20 bp, Artificial Sequence
  Description of Artificial Sequence: Synthetic oligonucleotide
ttcacttctttctttttcgc

SEQ ID NO: 6498 - DNA, 20 bp, Artificial Sequence
  Description of Artificial Sequence: Synthetic oligonucleotide
cattttctactttttttccg

SEQ ID NO: 6499 - DNA, 20 bp, Artificial Sequence
  Description of Artificial Sequence: Synthetic oligonucleotide
ctctttgcttctttatcccg

SEQ ID NO: 6500 - DNA, 22 bp, Artificial Sequence
  Description of Artificial Sequence: Synthetic oligonucleotide
tatttcactgttttttttgctg

SEQ ID NO: 6501 - DNA, 20 bp, Artificial Sequence
  Description of Artificial Sequence: Synthetic oligonucleotide
tttttcgtgtttttaccccg

SEQ ID NO: 6502 - DNA, 20 bp, Artificial Sequence
  Description of Artificial Sequence: Synthetic oligonucleotide
ttattgtttcattttgtgtg

SEQ ID NO: 6503 - DNA, 20 bp, Artificial Sequence
  Description of Artificial Sequence: Synthetic oligonucleotide
cttatttatctttctctccg

SEQ ID NO: 6504 - DNA, 21 bp, Artificial Sequence
  Description of Artificial Sequence: Synthetic oligonucleotide
tttgctttttttttccttgcc

SEQ ID NO: 6505 - DNA, 19 bp, Artificial Sequence
  Description of Artificial Sequence: Synthetic oligonucleotide
attattgctttttttgctg

SEQ ID NO: 6506 - DNA, 20 bp, Artificial Sequence
  Description of Artificial Sequence: Synthetic oligonucleotide
ctctttaccttttattcccg

SEQ ID NO: 6507 - DNA, 20 bp, Artificial Sequence
  Description of Artificial Sequence: Synthetic oligonucleotide
tacttttgtttctttttctg

SEQ ID NO: 6508 - DNA, 20 bp, Artificial Sequence
  Description of Artificial Sequence: Synthetic oligonucleotide
ctttatcctgcaagcctgta

SEQ ID NO: 6509 - DNA, 20 bp, Artificial Sequence
  Description of Artificial Sequence: Synthetic oligonucleotide
gttattcattacttttgccg

SEQ ID NO: 6510 - DNA, 20 bp, Artificial Sequence
  Description of Artificial Sequence: Synthetic oligonucleotide
atatttctaactttttactg

SEQ ID NO: 6511 - DNA, 20 bp, Artificial Sequence
  Description of Artificial Sequence: Synthetic oligonucleotide
gcccttcgttctgctctccc

SEQ ID NO: 6512 - DNA, 20 bp, Artificial Sequence
  Description of Artificial Sequence: Synthetic oligonucleotide
tttgaagggcgatgggtcct

SEQ ID NO: 6513 - DNA, 20 bp, Artificial Sequence
  Description of Artificial Sequence: Synthetic oligonucleotide
ttttctttctttatttgccg

SEQ ID NO: 6514 - DNA, 19 bp, Artificial Sequence
  Description of Artificial Sequence: Synthetic oligonucleotide
attttcattttttccgccg

SEQ ID NO: 6515 - DNA, 20 bp, Artificial Sequence
  Description of Artificial Sequence: Synthetic oligonucleotide
tctttttctctatctctccg

SEQ ID NO: 6516 - DNA, 21 bp, Artificial Sequence
  Description of Artificial Sequence: Synthetic oligonucleotide
acttttttttcttttctaccg

SEQ ID NO: 6517 - DNA, 20 bp, Artificial Sequence
  Description of Artificial Sequence: Synthetic oligonucleotide
ttttttgtttctttcccccg

SEQ ID NO: 6518 - DNA, 20 bp, Artificial Sequence
  Description of Artificial Sequence: Synthetic oligonucleotide
cctttttgcttcctttgctg

SEQ ID NO: 6519 - DNA, 20 bp, Artificial Sequence
  Description of Artificial Sequence: Synthetic oligonucleotide
cttttatatcctctgctccg

SEQ ID NO: 6520 - DNA, 22 bp, Artificial Sequence
  Description of Artificial Sequence: Synthetic oligonucleotide
aatattactttttttttccccg

SEQ ID NO: 6521 - DNA, 20 bp, Artificial Sequence
  Description of Artificial Sequence: Synthetic oligonucleotide
cttacacttcatattttccg

SEQ ID NO: 6522 - DNA, 18 bp, Artificial Sequence
  Description of Artificial Sequence: Synthetic oligonucleotide
tttctttcattttttccg

SEQ ID NO: 6523 - DNA, 21 bp, Artificial Sequence
  Description of Artificial Sequence: Synthetic oligonucleotide
ttttccgttcctttttttccg

SEQ ID NO: 6524 - DNA, 19 bp, Artificial Sequence
  Description of Artificial Sequence: Synthetic oligonucleotide
cttttgctctttttctccg

SEQ ID NO: 6525 - DNA, 22 bp, Artificial Sequence
  Description of Artificial Sequence: Synthetic oligonucleotide
ttttacttgttttttttgtccg

SEQ ID NO: 6526 - DNA, 20 bp, Artificial Sequence
  Description of Artificial Sequence: Synthetic oligonucleotide
attccacttttttttcgccg

SEQ ID NO: 6527 - DNA, 19 bp, Artificial Sequence
  Description of Artificial Sequence: Synthetic oligonucleotide
atctttatttttctctccg

SEQ ID NO: 6528 - DNA, 20 bp, Artificial Sequence
  Description of Artificial Sequence: Synthetic oligonucleotide
gttggtgtaggggggctccg

SEQ ID NO: 6529 - DNA, 19 bp, Artificial Sequence
  Description of Artificial Sequence: Synthetic oligonucleotide
ttttctttctattcttccg

SEQ ID NO: 6530 - DNA, 22 bp, Artificial Sequence
  Description of Artificial Sequence: Synthetic oligonucleotide
ttttgccatgttttttttaccg

SEQ ID NO: 6531 - DNA, 20 bp, Artificial Sequence
  Description of Artificial Sequence: Synthetic oligonucleotide
ttttaactttttcctttgca

SEQ ID NO: 6532 - DNA, 20 bp, Artificial Sequence
  Description of Artificial Sequence: Synthetic oligonucleotide
cctttttatttcattttccg

SEQ ID NO: 6533 - DNA, 20 bp, Artificial Sequence
  Description of Artificial Sequence: Synthetic oligonucleotide
tttattttcgattttctgcc

SEQ ID NO: 6534 - DNA, 20 bp, Artificial Sequence
  Description of Artificial Sequence: Synthetic oligonucleotide
tcctttatcttgtttttccg

SEQ ID NO: 6535 - DNA, 19 bp, Artificial Sequence
  Description of Artificial Sequence: Synthetic oligonucleotide
tttttctaattacgttccg

SEQ ID NO: 6536 - DNA, 20 bp, Artificial Sequence
  Description of Artificial Sequence: Synthetic oligonucleotide
ttattctctttttttgtgtc

SEQ ID NO: 6537 - DNA, 20 bp, Artificial Sequence
  Description of Artificial Sequence: Synthetic oligonucleotide
cttttttggttttctttccg

SEQ ID NO: 6538 - DNA, 20 bp, Artificial Sequence
  Description of Artificial Sequence: Synthetic oligonucleotide
tttgggttcttttttttctg

SEQ ID NO: 6539 - DNA, 20 bp, Artificial Sequence
  Description of Artificial Sequence: Synthetic oligonucleotide
gtttcgcctgttttcttccg

SEQ ID NO: 6540 - DNA, 20 bp, Artificial Sequence
  Description of Artificial Sequence: Synthetic oligonucleotide
gttttatttattcgtttccg

SEQ ID NO: 6541 - DNA, 20 bp, Artificial Sequence
  Description of Artificial Sequence: Synthetic oligonucleotide
tactattcttctttttgccg

SEQ ID NO: 6542 - DNA, 19 bp, Artificial Sequence
  Description of Artificial Sequence: Synthetic oligonucleotide
tttctttactttctttccg

SEQ ID NO: 6543 - DNA, 20 bp, Artificial Sequence
  Description of Artificial Sequence: Synthetic oligonucleotide
ccttttaacgtttcgctccg

SEQ ID NO: 6544 - DNA, 21 bp, Artificial Sequence
  Description of Artificial Sequence: Synthetic oligonucleotide
ttttagctttttttttgtccg

SEQ ID NO: 6545 - DNA, 20 bp, Artificial Sequence
  Description of Artificial Sequence: Synthetic oligonucleotide
tttttacctttttcgttccg

SEQ ID NO: 6546 - DNA, 22 bp, Artificial Sequence
  Description of Artificial Sequence: Synthetic oligonucleotide
tcttttttttcttctacccccg

SEQ ID NO: 6547 - DNA, 20 bp, Artificial Sequence
  Description of Artificial Sequence: Synthetic oligonucleotide
tcttttaacgtgttttcccg

SEQ ID NO: 6548 - DNA, 20 bp, Artificial Sequence
  Description of Artificial Sequence: Synthetic oligonucleotide
gtttcttctttattactccc

SEQ ID NO: 6549 - DNA, 21 bp, Artificial Sequence
  Description of Artificial Sequence: Synthetic oligonucleotide
ttctttatttttttccctcct

SEQ ID NO: 6550 - DNA, 20 bp, Artificial Sequence
  Description of Artificial Sequence: Synthetic oligonucleotide
tttggggttttccagtgccc

SEQ ID NO: 6551 - DNA, 20 bp, Artificial Sequence
  Description of Artificial Sequence: Synthetic oligonucleotide
ccctgtcgtctttgcgtccc

SEQ ID NO: 6552 - DNA, 20 bp, Artificial Sequence
  Description of Artificial Sequence: Synthetic oligonucleotide
tccttatcgtcttgcgtccc

SEQ ID NO: 6553 - DNA, 20 bp, Artificial Sequence
  Description of Artificial Sequence: Synthetic oligonucleotide
tcctgacgtctgtgcgtccc

SEQ ID NO: 6554 - DNA, 18 bp, Artificial Sequence
  Description of Artificial Sequence: Synthetic oligonucleotide
ctttgctctttttctccg

SEQ ID NO: 6555 - DNA, 20 bp, Artificial Sequence
  Description of Artificial Sequence: Synthetic oligonucleotide
tgagtcgttctcttcgtccc

SEQ ID NO: 6556 - DNA, 20 bp, Artificial Sequence
  Description of Artificial Sequence: Synthetic oligonucleotide
tttatttcttccacgttccg

SEQ ID NO: 6557 - DNA, 20 bp, Artificial Sequence
  Description of Artificial Sequence: Synthetic oligonucleotide
atctttattttttccctccg

SEQ ID NO: 6558 - DNA, 20 bp, Artificial Sequence
  Description of Artificial Sequence: Synthetic oligonucleotide
taccttatcctgcaggtccc

SEQ ID NO: 6559 - DNA, 21 bp, Artificial Sequence
  Description of Artificial Sequence: Synthetic oligonucleotide
gtcctgtcgtctgtttgtccc

SEQ ID NO: 6560 - DNA, 20 bp, Artificial Sequence
  Description of Artificial Sequence: Synthetic oligonucleotide
tcctggcttgttgttgtccc

SEQ ID NO: 6561 - DNA, 18 bp, Artificial Sequence
  Description of Artificial Sequence: Synthetic oligonucleotide
tttactttcctcttgccg

SEQ ID NO: 6562 - DNA, 20 bp, Artificial Sequence
  Description of Artificial Sequence: Synthetic oligonucleotide
tttgggagaagggggttccg

SEQ ID NO: 6563 - DNA, 20 bp, Artificial Sequence
  Description of Artificial Sequence: Synthetic oligonucleotide
ttacccttacttttgctccg

SEQ ID NO: 6564 - DNA, 19 bp, Artificial Sequence
  Description of Artificial Sequence: Synthetic oligonucleotide
atttttcctgtttttgccg

SEQ ID NO: 6565 - DNA, 20 bp, Artificial Sequence
  Description of Artificial Sequence: Synthetic oligonucleotide
atgcttggagtatggaggtg

SEQ ID NO: 6566 - DNA, 20 bp, Artificial Sequence
  Description of Artificial Sequence: Synthetic oligonucleotide
tttgaagggtgatgtttccg

SEQ ID NO: 6567 - DNA, 20 bp, Artificial Sequence
  Description of Artificial Sequence: Synthetic oligonucleotide
tcctgtcgtctggttgtccc

SEQ ID NO: 6568 - DNA, 20 bp, Artificial Sequence
  Description of Artificial Sequence: Synthetic oligonucleotide
atcttttctttcctctgccg

SEQ ID NO: 6569 - DNA, 20 bp, Artificial Sequence
  Description of Artificial Sequence: Synthetic oligonucleotide
tttttgctcttttccctccg

SEQ ID NO: 6570 - DNA, 20 bp, Artificial Sequence
  Description of Artificial Sequence: Synthetic oligonucleotide
tcttttcgttctgccctccc

SEQ ID NO: 6571 - DNA, 19 bp, Artificial Sequence
  Description of Artificial Sequence: Synthetic oligonucleotide
tctttgttattttcatccg

SEQ ID NO: 6572 - DNA, 20 bp, Artificial Sequence
  Description of Artificial Sequence: Synthetic oligonucleotide
tgttttttactcttttgcgc

SEQ ID NO: 6573 - DNA, 20 bp, Artificial Sequence
  Description of Artificial Sequence: Synthetic oligonucleotide
accattcttatctccttccg

SEQ ID NO: 6574 - DNA, 20 bp, Artificial Sequence
  Description of Artificial Sequence: Synthetic oligonucleotide
aattacttactttttacccc

SEQ ID NO: 6575 - DNA, 21 bp, Artificial Sequence
  Description of Artificial Sequence: Synthetic oligonucleotide
attcttttgttttttttcccg

SEQ ID NO: 6576 - DNA, 20 bp, Artificial Sequence
  Description of Artificial Sequence: Synthetic oligonucleotide
cctttcttattctacctccg

SEQ ID NO: 6577 - DNA, 20 bp, Artificial Sequence
  Description of Artificial Sequence: Synthetic oligonucleotide
gtattgctttctttttgccc

SEQ ID NO: 6578 - DNA, 20 bp, Artificial Sequence
  Description of Artificial Sequence: Synthetic oligonucleotide
tactttctttccaccttccg

SEQ ID NO: 6579 - DNA, 21 bp, Artificial Sequence
  Description of Artificial Sequence: Synthetic oligonucleotide
atttctctttttttcgtcccg

SEQ ID NO: 6580 - DNA, 20 bp, Artificial Sequence
  Description of Artificial Sequence: Synthetic oligonucleotide
gtttatagcctctttttccg

SEQ ID NO: 6581 - DNA, 19 bp, Artificial Sequence
  Description of Artificial Sequence: Synthetic oligonucleotide
tttccttttttcccatccg

SEQ ID NO: 6582 - DNA, 22 bp, Artificial Sequence
  Description of Artificial Sequence: Synthetic oligonucleotide
gcctttttcgttctgccctccc

SEQ ID NO: 6583 - DNA, 21 bp, Artificial Sequence
  Description of Artificial Sequence: Synthetic oligonucleotide
ctccttgttgctttttctccg

SEQ ID NO: 6584 - DNA, 20 bp, Artificial Sequence
  Description of Artificial Sequence: Synthetic oligonucleotide
ttatcacttttccttgtccc

SEQ ID NO: 6585 - DNA, 22 bp, Artificial Sequence
  Description of Artificial Sequence: Synthetic oligonucleotide
ctttcactttttttcctctccg

SEQ ID NO: 6586 - DNA, 19 bp, Artificial Sequence
  Description of Artificial Sequence: Synthetic oligonucleotide
attactcttctctttgccg

SEQ ID NO: 6587 - DNA, 20 bp, Artificial Sequence
  Description of Artificial Sequence: Synthetic oligonucleotide
ccttttaccttttttctccg

SEQ ID NO: 6588 - DNA, 20 bp, Artificial Sequence
  Description of Artificial Sequence: Synthetic oligonucleotide
tttctttttattcctgtccg

SEQ ID NO: 6589 - DNA, 20 bp, Artificial Sequence
  Description of Artificial Sequence: Synthetic oligonucleotide
attcacttcttttctttccg

SEQ ID NO: 6590 - DNA, 21 bp, Artificial Sequence
  Description of Artificial Sequence: Synthetic oligonucleotide
tcttttcatgttttctctccg

SEQ ID NO: 6591 - DNA, 20 bp, Artificial Sequence
  Description of Artificial Sequence: Synthetic oligonucleotide
gttcactctttccattcccc

SEQ ID NO: 6592 - DNA, 21 bp, Artificial Sequence
  Description of Artificial Sequence: Synthetic oligonucleotide
agttttttgtcttttttcccc

SEQ ID NO: 6593 - DNA, 20 bp, Artificial Sequence
  Description of Artificial Sequence: Synthetic oligonucleotide
cttaccgttttcttcttccg

SEQ ID NO: 6594 - DNA, 20 bp, Artificial Sequence
  Description of Artificial Sequence: Synthetic oligonucleotide
ctctattatcctcttctccg

SEQ ID NO: 6595 - DNA, 20 bp, Artificial Sequence
  Description of Artificial Sequence: Synthetic oligonucleotide
gtttgtttctttagtttccc

SEQ ID NO: 6596 - DNA, 21 bp, Artificial Sequence
  Description of Artificial Sequence: Synthetic oligonucleotide
ctttttttgttctttcatccg

SEQ ID NO: 6597 - DNA, 20 bp, Artificial Sequence
  Description of Artificial Sequence: Synthetic oligonucleotide
tattgcttgtatttcctccg

SEQ ID NO: 6598 - DNA, 20 bp, Artificial Sequence
  Description of Artificial Sequence: Synthetic oligonucleotide
tctacctttacttcttcccg

SEQ ID NO: 6599 - DNA, 19 bp, Artificial Sequence
  Description of Artificial Sequence: Synthetic oligonucleotide
gcttttcgttctgcctccc

SEQ ID NO: 6600 - DNA, 20 bp, Artificial Sequence
  Description of Artificial Sequence: Synthetic oligonucleotide
gcctctcgttctgctctccc

SEQ ID NO: 6601 - DNA, 20 bp, Artificial Sequence
  Description of Artificial Sequence: Synthetic oligonucleotide
cttcttttatctctcttccg

SEQ ID NO: 6602 - DNA, 20 bp, Artificial Sequence
  Description of Artificial Sequence: Synthetic oligonucleotide
catttcaccttacttttccg

SEQ ID NO: 6603 - DNA, 19 bp, Artificial Sequence
  Description of Artificial Sequence: Synthetic oligonucleotide
atcttcttattttctgccg

SEQ ID NO: 6604 - DNA, 20 bp, Artificial Sequence
  Description of Artificial Sequence: Synthetic oligonucleotide
ctttcattgttcttttgccc

SEQ ID NO: 6605 - DNA, 21 bp, Artificial Sequence
  Description of Artificial Sequence: Synthetic oligonucleotide
tttgtattccccttttttccg

SEQ ID NO: 6606 - DNA, 19 bp, Artificial Sequence
  Description of Artificial Sequence: Synthetic oligonucleotide
ttttcttttcctttgtccg

SEQ ID NO: 6607 - DNA, 20 bp, Artificial Sequence
  Description of Artificial Sequence: Synthetic oligonucleotide
gttggagtaggggggttccg

SEQ ID NO: 6608 - DNA, 21 bp, Artificial Sequence
  Description of Artificial Sequence: Synthetic oligonucleotide
attttctctttttttttgccg

SEQ ID NO: 6609 - DNA, 20 bp, Artificial Sequence
  Description of Artificial Sequence: Synthetic oligonucleotide
tcacttttcttttcttaccc

SEQ ID NO: 6610 - DNA, 20 bp, Artificial Sequence
  Description of Artificial Sequence: Synthetic oligonucleotide
tttgtagggtgatgggaccg

SEQ ID NO: 6611 - DNA, 20 bp, Artificial Sequence
  Description of Artificial Sequence: Synthetic oligonucleotide
atatcctcttttttctgccg

SEQ ID NO: 6612 - DNA, 20 bp, Artificial Sequence
  Description of Artificial Sequence: Synthetic oligonucleotide
ttattcctttttcttgccgc

SEQ ID NO: 6613 - DNA, 20 bp, Artificial Sequence
  Description of Artificial Sequence: Synthetic oligonucleotide
gttggtgtaggggtgttccg

SEQ ID NO: 6614 - DNA, 20 bp, Artificial Sequence
  Description of Artificial Sequence: Synthetic oligonucleotide
tttgaaggggtatgggtccg

SEQ ID NO: 6615 - DNA, 21 bp, Artificial Sequence
  Description of Artificial Sequence: Synthetic oligonucleotide
gtttttgttggtttttttccg

SEQ ID NO: 6616 - DNA, 20 bp, Artificial Sequence
  Description of Artificial Sequence: Synthetic oligonucleotide
ttttatatcttccttttgcc

SEQ ID NO: 6617 - DNA, 21 bp, Artificial Sequence
  Description of Artificial Sequence: Synthetic oligonucleotide
ccttttttattccttttgccg

SEQ ID NO: 6618 - DNA, 21 bp, Artificial Sequence
  Description of Artificial Sequence: Synthetic oligonucleotide
ttttgaagggtgatgggcccg

SEQ ID NO: 6619 - DNA, 21 bp, Artificial Sequence
  Description of Artificial Sequence: Synthetic oligonucleotide
tttttttcctttcactatccg

SEQ ID NO: 6620 - DNA, 20 bp, Artificial Sequence
  Description of Artificial Sequence: Synthetic oligonucleotide
tcattcttttcttcttacgc

SEQ ID NO: 6621 - DNA, 20 bp, Artificial Sequence
  Description of Artificial Sequence: Synthetic oligonucleotide
tcttatactgatggccgcgt

SEQ ID NO: 6622 - DNA, 20 bp, Artificial Sequence
  Description of Artificial Sequence: Synthetic oligonucleotide
tctttatttgtactctcctg

SEQ ID NO: 6623 - DNA, 20 bp, Artificial Sequence
  Description of Artificial Sequence: Synthetic oligonucleotide
ttcgtttttgcatttctccg

SEQ ID NO: 6624 - DNA, 20 bp, Artificial Sequence
  Description of Artificial Sequence: Synthetic oligonucleotide
tgttgttttcgtgttttccg

SEQ ID NO: 6625 - DNA, 21 bp, Artificial Sequence
  Description of Artificial Sequence: Synthetic oligonucleotide
attccactttttttttcgccg

SEQ ID NO: 6626 - DNA, 20 bp, Artificial Sequence
  Description of Artificial Sequence: Synthetic oligonucleotide
aatttcttttctacccgccg

SEQ ID NO: 6627 - DNA, 20 bp, Artificial Sequence
  Description of Artificial Sequence: Synthetic oligonucleotide
actgtttttatcattttgcc

SEQ ID NO: 6628 - DNA, 20 bp, Artificial Sequence
  Description of Artificial Sequence: Synthetic oligonucleotide
tattttaattctcctttgcc

SEQ ID NO: 6629 - DNA, 20 bp, Artificial Sequence
  Description of Artificial Sequence: Synthetic oligonucleotide
ctcttttttttgtttccccg

SEQ ID NO: 6630 - DNA, 19 bp, Artificial Sequence
  Description of Artificial Sequence: Synthetic oligonucleotide
tgctttggttttttttccg

SEQ ID NO: 6631 - DNA, 20 bp, Artificial Sequence
  Description of Artificial Sequence: Synthetic oligonucleotide
tgtgcttgattatttttccg

SEQ ID NO: 6632 - DNA, 19 bp, Artificial Sequence
  Description of Artificial Sequence: Synthetic oligonucleotide
tttttgttttttttacccg

SEQ ID NO: 6633 - DNA, 20 bp, Artificial Sequence
  Description of Artificial Sequence: Synthetic oligonucleotide
cttttcttcttttccttccg

SEQ ID NO: 6634 - DNA, 20 bp, Artificial Sequence
  Description of Artificial Sequence: Synthetic oligonucleotide
ttttttatatcatgttcccg

SEQ ID NO: 6635 - DNA, 20 bp, Artificial Sequence
  Description of Artificial Sequence: Synthetic oligonucleotide
cttttcattctcttcgttgc

SEQ ID NO: 6636 - DNA, 20 bp, Artificial Sequence
  Description of Artificial Sequence: Synthetic oligonucleotide
cctgttttcttgttattccg

SEQ ID NO: 6637 - DNA, 20 bp, Artificial Sequence
  Description of Artificial Sequence: Synthetic oligonucleotide
cttattcttactttactccg

SEQ ID NO: 6638 - DNA, 20 bp, Artificial Sequence
  Description of Artificial Sequence: Synthetic oligonucleotide
gccttatcttttttactccg

SEQ ID NO: 6639 - DNA, 20 bp, Artificial Sequence
  Description of Artificial Sequence: Synthetic oligonucleotide
ctttgttttattcttgttgc

SEQ ID NO: 6640 - DNA, 20 bp, Artificial Sequence
  Description of Artificial Sequence: Synthetic oligonucleotide
ctttgtcttttattctcccg

SEQ ID NO: 6641 - DNA, 20 bp, Artificial Sequence
  Description of Artificial Sequence: Synthetic oligonucleotide
tctctttagcattttttccg

SEQ ID NO: 6642 - DNA, 20 bp, Artificial Sequence
  Description of Artificial Sequence: Synthetic oligonucleotide
tgtctatttatttccttccg

SEQ ID NO: 6643 - DNA, 20 bp, Artificial Sequence
  Description of Artificial Sequence: Synthetic oligonucleotide
ttttcatcctgtcttgtccg

SEQ ID NO: 6644 - DNA, 20 bp, Artificial Sequence
  Description of Artificial Sequence: Synthetic oligonucleotide
gacttcttatcttttctccc

SEQ ID NO: 6645 - DNA, 20 bp, Artificial Sequence
  Description of Artificial Sequence: Synthetic oligonucleotide
ttttctattttaactctccc

SEQ ID NO: 6646 - DNA, 20 bp, Artificial Sequence
  Description of Artificial Sequence: Synthetic oligonucleotide
taccatttctttctcttgtg

SEQ ID NO: 6647 - DNA, 20 bp, Artificial Sequence
  Description of Artificial Sequence: Synthetic oligonucleotide
tattttcttttctgtgtccc

SEQ ID NO: 6648 - DNA, 20 bp, Artificial Sequence
  Description of Artificial Sequence: Synthetic oligonucleotide
ttttcttgctttttccgcta

SEQ ID NO: 6649 - DNA, 21 bp, Artificial Sequence
  Description of Artificial Sequence: Synthetic oligonucleotide
gtttttttacttatgttgccg

SEQ ID NO: 6650 - DNA, 20 bp, Artificial Sequence
  Description of Artificial Sequence: Synthetic oligonucleotide
ttcttgtattaatttttccg

SEQ ID NO: 6651 - DNA, 19 bp, Artificial Sequence
  Description of Artificial Sequence: Synthetic oligonucleotide
tcttttcatgtttattccc

SEQ ID NO: 6652 - DNA, 20 bp, Artificial Sequence
  Description of Artificial Sequence: Synthetic oligonucleotide
cattcctttatttcttcgcc

SEQ ID NO: 6653 - DNA, 22 bp, Artificial Sequence
  Description of Artificial Sequence: Synthetic oligonucleotide
cattcttctgtttttccttcgc

SEQ ID NO: 6654 - DNA, 20 bp, Artificial Sequence
  Description of Artificial Sequence: Synthetic oligonucleotide
cgaatggaggaggaggatgc

SEQ ID NO: 6655 - DNA, 20 bp, Artificial Sequence
  Description of Artificial Sequence: Synthetic oligonucleotide
attttcatatcttttcccgc

SEQ ID NO: 6656 - DNA, 20 bp, Artificial Sequence
  Description of Artificial Sequence: Synthetic oligonucleotide
tttttgttttgtttttgctg

SEQ ID NO: 6657 - DNA, 20 bp, Artificial Sequence
  Description of Artificial Sequence: Synthetic oligonucleotide
cttttctttcattttcccgg

SEQ ID NO: 6658 - DNA, 20 bp, Artificial Sequence
  Description of Artificial Sequence: Synthetic oligonucleotide
tttgctattcatttttcccc

SEQ ID NO: 6659 - DNA, 20 bp, Artificial Sequence
  Description of Artificial Sequence: Synthetic oligonucleotide
tttgggagtagggtgttcgg

SEQ ID NO: 6660 - DNA, 20 bp, Artificial Sequence
  Description of Artificial Sequence: Synthetic oligonucleotide
gttggtgtagggggggtccg

SEQ ID NO: 6661 - DNA, 20 bp, Artificial Sequence
  Description of Artificial Sequence: Synthetic oligonucleotide
tactttttcttccttttcca

SEQ ID NO: 6662 - DNA, 20 bp, Artificial Sequence
  Description of Artificial Sequence: Synthetic oligonucleotide
ttcgtttattaatttctccg

SEQ ID NO: 6663 - DNA, 20 bp, Artificial Sequence
  Description of Artificial Sequence: Synthetic oligonucleotide
cttttaaactccttttcccg

SEQ ID NO: 6664 - DNA, 20 bp, Artificial Sequence
  Description of Artificial Sequence: Synthetic oligonucleotide
ttttttagatagtttttgtg

SEQ ID NO: 6665 - DNA, 20 bp, Artificial Sequence
  Description of Artificial Sequence: Synthetic oligonucleotide
tttccactacattatttccg

SEQ ID NO: 6666 - DNA, 20 bp, Artificial Sequence
  Description of Artificial Sequence: Synthetic oligonucleotide
cttttctcatgccttatccg

SEQ ID NO: 6667 - DNA, 21 bp, Artificial Sequence
  Description of Artificial Sequence: Synthetic oligonucleotide
tttgctctctatttttttccg

SEQ ID NO: 6668 - DNA, 20 bp, Artificial Sequence
  Description of Artificial Sequence: Synthetic oligonucleotide
tctctgtcattctatttccg

SEQ ID NO: 6669 - DNA, 20 bp, Artificial Sequence
  Description of Artificial Sequence: Synthetic oligonucleotide
attctactattactccaccg

SEQ ID NO: 6670 - DNA, 20 bp, Artificial Sequence
  Description of Artificial Sequence: Synthetic oligonucleotide
tttcatatttctctcctctg

SEQ ID NO: 6671 - DNA, 20 bp, Artificial Sequence
  Description of Artificial Sequence: Synthetic oligonucleotide
cactcactttttttcttcgc

SEQ ID NO: 6672 - DNA, 20 bp, Artificial Sequence
  Description of Artificial Sequence: Synthetic oligonucleotide
gcctctcctttttcttcccg

SEQ ID NO: 6673 - DNA, 21 bp, Artificial Sequence
  Description of Artificial Sequence: Synthetic oligonucleotide
tttacattttctcacctgccc

SEQ ID NO: 6674 - DNA, 19 bp, Artificial Sequence
  Description of Artificial Sequence: Synthetic oligonucleotide
ctttctttgtttccttccg

SEQ ID NO: 6675 - DNA, 20 bp, Artificial Sequence
  Description of Artificial Sequence: Synthetic oligonucleotide
attttttgccgtgttctccg

SEQ ID NO: 6676 - DNA, 21 bp, Artificial Sequence
  Description of Artificial Sequence: Synthetic oligonucleotide
atttttctcttttttctgccg

SEQ ID NO: 6677 - DNA, 20 bp, Artificial Sequence
  Description of Artificial Sequence: Synthetic oligonucleotide
ttttctcttttccttttccg

SEQ ID NO: 6678 - DNA, 22 bp, Artificial Sequence
  Description of Artificial Sequence: Synthetic oligonucleotide
tttctttttttgtcttgctccg

SEQ ID NO: 6679 - DNA, 20 bp, Artificial Sequence
  Description of Artificial Sequence: Synthetic oligonucleotide
tttcttttgctttttctccg

SEQ ID NO: 6680 - DNA, 19 bp, Artificial Sequence
  Description of Artificial Sequence: Synthetic oligonucleotide
ttttttgtcttttgctccg

SEQ ID NO: 6681 - DNA, 21 bp, Artificial Sequence
  Description of Artificial Sequence: Synthetic oligonucleotide
tttatttttctcgttgttgtg

SEQ ID NO: 6682 - DNA, 20 bp, Artificial Sequence
  Description of Artificial Sequence: Synthetic oligonucleotide
ttcactttcttttctctccg

SEQ ID NO: 6683 - DNA, 19 bp, Artificial Sequence
  Description of Artificial Sequence: Synthetic oligonucleotide
tcttttcatgtttcttccg

SEQ ID NO: 6684 - DNA, 20 bp, Artificial Sequence
  Description of Artificial Sequence: Synthetic oligonucleotide
ttatctaactcttttccccg

SEQ ID NO: 6685 - DNA, 20 bp, Artificial Sequence
  Description of Artificial Sequence: Synthetic oligonucleotide
ttgttactgattttattccg

SEQ ID NO: 6686 - DNA, 19 bp, Artificial Sequence
  Description of Artificial Sequence: Synthetic oligonucleotide
ttttcactttttctttgcc

SEQ ID NO: 6687 - DNA, 20 bp, Artificial Sequence
  Description of Artificial Sequence: Synthetic oligonucleotide
ttcatttgtattttatcccc

SEQ ID NO: 6688 - DNA, 20 bp, Artificial Sequence
  Description of Artificial Sequence: Synthetic oligonucleotide
caccattttgtttttctccg

SEQ ID NO: 6689 - DNA, 20 bp, Artificial Sequence
  Description of Artificial Sequence: Synthetic oligonucleotide
ttccttcattattcttgccg

SEQ ID NO: 6690 - DNA, 20 bp, Artificial Sequence
  Description of Artificial Sequence: Synthetic oligonucleotide
ttctatattttattcttctg

SEQ ID NO: 6691 - DNA, 20 bp, Artificial Sequence
  Description of Artificial Sequence: Synthetic oligonucleotide
tttcatacttgttttctgcc

SEQ ID NO: 6692 - DNA, 20 bp, Artificial Sequence
  Description of Artificial Sequence: Synthetic oligonucleotide
tttgttcttctctttttccg

SEQ ID NO: 6693 - DNA, 20 bp, Artificial Sequence
  Description of Artificial Sequence: Synthetic oligonucleotide
tctcatcttttttttttccg

SEQ ID NO: 6694 - DNA, 20 bp, Artificial Sequence
  Description of Artificial Sequence: Synthetic oligonucleotide
ccctttatttgcttattccg

SEQ ID NO: 6695 - DNA, 20 bp, Artificial Sequence
  Description of Artificial Sequence: Synthetic oligonucleotide
ctctctttttattctttccg

SEQ ID NO: 6696 - DNA, 20 bp, Artificial Sequence
  Description of Artificial Sequence: Synthetic oligonucleotide
acttttactttatcctgctg

SEQ ID NO: 6697 - DNA, 20 bp, Artificial Sequence
  Description of Artificial Sequence: Synthetic oligonucleotide
tttgggagtagggtgtttcg

SEQ ID NO: 6698 - DNA, 21 bp, Artificial Sequence
  Description of Artificial Sequence: Synthetic oligonucleotide
ttttccatttttttcactccg

SEQ ID NO: 6699 - DNA, 20 bp, Artificial Sequence
  Description of Artificial Sequence: Synthetic oligonucleotide
ggtgaagggtgatgggtccg

SEQ ID NO: 6700 - DNA, 20 bp, Artificial Sequence
  Description of Artificial Sequence: Synthetic oligonucleotide
tttgtttttccctttttccg

SEQ ID NO: 6701 - DNA, 20 bp, Artificial Sequence
  Description of Artificial Sequence: Synthetic oligonucleotide
cttatggagtagggaggcgc

SEQ ID NO: 6702 - DNA, 21 bp, Artificial Sequence
  Description of Artificial Sequence: Synthetic oligonucleotide
ccatctcttttttttcctccg

SEQ ID NO: 6703 - DNA, 21 bp, Artificial Sequence
  Description of Artificial Sequence: Synthetic oligonucleotide
tttgttttttgtgcttttccc

SEQ ID NO: 6704 - DNA, 20 bp, Artificial Sequence
  Description of Artificial Sequence: Synthetic oligonucleotide
cttttttagatctttttccg

SEQ ID NO: 6705 - DNA, 20 bp, Artificial Sequence
  Description of Artificial Sequence: Synthetic oligonucleotide
caacttttctttttattccc

SEQ ID NO: 6706 - DNA, 20 bp, Artificial Sequence
  Description of Artificial Sequence: Synthetic oligonucleotide
ctttttcttttccctttccg

SEQ ID NO: 6707 - DNA, 19 bp, Artificial Sequence
  Description of Artificial Sequence: Synthetic oligonucleotide
ttttctatctttttgtccg

SEQ ID NO: 6708 - DNA, 21 bp, Artificial Sequence
  Description of Artificial Sequence: Synthetic oligonucleotide
cttttctcttcttgtctaccg

SEQ ID NO: 6709 - DNA, 20 bp, Artificial Sequence
  Description of Artificial Sequence: Synthetic oligonucleotide
tttgaagtgtgatgtgtccg

SEQ ID NO: 6710 - DNA, 20 bp, Artificial Sequence
  Description of Artificial Sequence: Synthetic oligonucleotide
tctttttatttgcctttccg

SEQ ID NO: 6711 - DNA, 20 bp, Artificial Sequence
  Description of Artificial Sequence: Synthetic oligonucleotide
ccttttaacatgtttttccg

SEQ ID NO: 6712 - DNA, 21 bp, Artificial Sequence
  Description of Artificial Sequence: Synthetic oligonucleotide
tttcatttttctctacttccg

SEQ ID NO: 6713 - DNA, 20 bp, Artificial Sequence
  Description of Artificial Sequence: Synthetic oligonucleotide
cttattatctcgttcttccg

SEQ ID NO: 6714 - DNA, 20 bp, Artificial Sequence
  Description of Artificial Sequence: Synthetic oligonucleotide
ctttcactttttttcttccg

SEQ ID NO: 6715 - DNA, 22 bp, Artificial Sequence
  Description of Artificial Sequence: Synthetic oligonucleotide
aattatttgttttttgtgaccg

SEQ ID NO: 6716 - DNA, 20 bp, Artificial Sequence
  Description of Artificial Sequence: Synthetic oligonucleotide
aaccataatgtgtggtgccc

SEQ ID NO: 6717 - DNA, 20 bp, Artificial Sequence
  Description of Artificial Sequence: Synthetic oligonucleotide
tgtgggagtagggtgttccg

SEQ ID NO: 6718 - DNA, 20 bp, Artificial Sequence
  Description of Artificial Sequence: Synthetic oligonucleotide
cgtttcctctgtttcgtccc

SEQ ID NO: 6719 - DNA, 18 bp, Artificial Sequence
  Description of Artificial Sequence: Synthetic oligonucleotide
ttgggtgtagggtggtgc

SEQ ID NO: 6720 - DNA, 20 bp, Artificial Sequence
  Description of Artificial Sequence: Synthetic oligonucleotide
tgactcgtctgttccgtccc

SEQ ID NO: 6721 - DNA, 19 bp, Artificial Sequence
  Description of Artificial Sequence: Synthetic oligonucleotide
ttggtgtaggggggttccg

SEQ ID NO: 6722 - DNA, 20 bp, Artificial Sequence
  Description of Artificial Sequence: Synthetic oligonucleotide
tcctgtcttctgctcgtccc

SEQ ID NO: 6723 - DNA, 20 bp, Artificial Sequence
  Description of Artificial Sequence: Synthetic oligonucleotide
gcccttcgttctaccctccc

SEQ ID NO: 6724 - DNA, 20 bp, Artificial Sequence
  Description of Artificial Sequence: Synthetic oligonucleotide
tttgaaaggtgatgggtccc

SEQ ID NO: 6725 - DNA, 20 bp, Artificial Sequence
  Description of Artificial Sequence: Synthetic oligonucleotide
tttgaagggctattggtccg

SEQ ID NO: 6726 - DNA, 20 bp, Artificial Sequence
  Description of Artificial Sequence: Synthetic oligonucleotide
tttggggttttcgcgtgccc

SEQ ID NO: 6727 - DNA, 20 bp, Artificial Sequence
  Description of Artificial Sequence: Synthetic oligonucleotide
tttactcttttctttgcccc

SEQ ID NO: 6728 - DNA, 20 bp, Artificial Sequence
  Description of Artificial Sequence: Synthetic oligonucleotide
tttcttcaccactttccccg

SEQ ID NO: 6729 - DNA, 20 bp, Artificial Sequence
  Description of Artificial Sequence: Synthetic oligonucleotide
tattcctcatcttttcgccg

SEQ ID NO: 6730 - DNA, 20 bp, Artificial Sequence
  Description of Artificial Sequence: Synthetic oligonucleotide
cgattcctctagttcgtccc

SEQ ID NO: 6731 - DNA, 20 bp, Artificial Sequence
  Description of Artificial Sequence: Synthetic oligonucleotide
cttttcttaatttcgctccg

SEQ ID NO: 6732 - DNA, 21 bp, Artificial Sequence
  Description of Artificial Sequence: Synthetic oligonucleotide
gtcctgacgtctgttcgtccc

SEQ ID NO: 6733 - DNA, 20 bp, Artificial Sequence
  Description of Artificial Sequence: Synthetic oligonucleotide
tattctcacactttttgccc

SEQ ID NO: 6734 - DNA, 20 bp, Artificial Sequence
  Description of Artificial Sequence: Synthetic oligonucleotide
tcctttcgttctcccctccc

SEQ ID NO: 6735 - DNA, 19 bp, Artificial Sequence
  Description of Artificial Sequence: Synthetic oligonucleotide
ttattttccttttctgccg

SEQ ID NO: 6736 - DNA, 20 bp, Artificial Sequence
  Description of Artificial Sequence: Synthetic oligonucleotide
tcacaatttctttacgtccc

SEQ ID NO: 6737 - DNA, 20 bp, Artificial Sequence
  Description of Artificial Sequence: Synthetic oligonucleotide
tcctttcgttctgcccttcc

SEQ ID NO: 6738 - DNA, 20 bp, Artificial Sequence
  Description of Artificial Sequence: Synthetic oligonucleotide
gtcacttttaattccctccg

SEQ ID NO: 6739 - DNA, 19 bp, Artificial Sequence
  Description of Artificial Sequence: Synthetic oligonucleotide
tttatttctcgttgttgtg

SEQ ID NO: 6740 - DNA, 20 bp, Artificial Sequence
  Description of Artificial Sequence: Synthetic oligonucleotide
agtttttgccttgttgtccg

SEQ ID NO: 6741 - DNA, 20 bp, Artificial Sequence
  Description of Artificial Sequence: Synthetic oligonucleotide
gttttccacttttttatccc

SEQ ID NO: 6742 - DNA, 20 bp, Artificial Sequence
  Description of Artificial Sequence: Synthetic oligonucleotide
tcatcacttttcttctgccg

SEQ ID NO: 6743 - DNA, 21 bp, Artificial Sequence
  Description of Artificial Sequence: Synthetic oligonucleotide
gttttgtcttttttccttccg

SEQ ID NO: 6744 - DNA, 20 bp, Artificial Sequence
  Description of Artificial Sequence: Synthetic oligonucleotide
tcacatttatttttctgctg

SEQ ID NO: 6745 - DNA, 20 bp, Artificial Sequence
  Description of Artificial Sequence: Synthetic oligonucleotide
tttgggaggaggggggtccg

SEQ ID NO: 6746 - DNA, 20 bp, Artificial Sequence
  Description of Artificial Sequence: Synthetic oligonucleotide
ttccttattttttccctccg

SEQ ID NO: 6747 - DNA, 18 bp, Artificial Sequence
  Description of Artificial Sequence: Synthetic oligonucleotide
cttttcttcgctttaccg

SEQ ID NO: 6748 - DNA, 20 bp, Artificial Sequence
  Description of Artificial Sequence: Synthetic oligonucleotide
ccttttaccactttcctccg

SEQ ID NO: 6749 - DNA, 20 bp, Artificial Sequence
  Description of Artificial Sequence: Synthetic oligonucleotide
tttctaatttttgtcgtgtg

SEQ ID NO: 6750 - DNA, 18 bp, Artificial Sequence
  Description of Artificial Sequence: Synthetic oligonucleotide
cctttcgttctccctccc

SEQ ID NO: 6751 - DNA, 20 bp, Artificial Sequence
  Description of Artificial Sequence: Synthetic oligonucleotide
tcctttcgttcggccctccc

SEQ ID NO: 6752 - DNA, 19 bp, Artificial Sequence
  Description of Artificial Sequence: Synthetic oligonucleotide
cctttcgttctgctctccc

SEQ ID NO: 6753 - DNA, 20 bp, Artificial Sequence
  Description of Artificial Sequence: Synthetic oligonucleotide
tttctcttttcctctttccg

SEQ ID NO: 6754 - DNA, 20 bp, Artificial Sequence
  Description of Artificial Sequence: Synthetic oligonucleotide
tttcttactagttttctgcc

SEQ ID NO: 6755 - DNA, 20 bp, Artificial Sequence
  Description of Artificial Sequence: Synthetic oligonucleotide
tctttctgtcttttgctccg

SEQ ID NO: 6756 - DNA, 22 bp, Artificial Sequence
  Description of Artificial Sequence: Synthetic oligonucleotide
aattattgtttttttgtgaccg

SEQ ID NO: 6757 - DNA, 20 bp, Artificial Sequence
  Description of Artificial Sequence: Synthetic oligonucleotide
atcttttccttcttctgccg

SEQ ID NO: 6758 - DNA, 20 bp, Artificial Sequence
  Description of Artificial Sequence: Synthetic oligonucleotide
tttgggagtagggtattccg

SEQ ID NO: 6759 - DNA, 20 bp, Artificial Sequence
  Description of Artificial Sequence: Synthetic oligonucleotide
tcctgtcgtctgttcgtaac

SEQ ID NO: 6760 - DNA, 20 bp, Artificial Sequence
  Description of Artificial Sequence: Synthetic oligonucleotide
tactttccttgttttctccg

SEQ ID NO: 6761 - DNA, 21 bp, Artificial Sequence
  Description of Artificial Sequence: Synthetic oligonucleotide
tttgaaggggtgatgggtcct

SEQ ID NO: 6762 - DNA, 20 bp, Artificial Sequence
  Description of Artificial Sequence: Synthetic oligonucleotide
atttggaggaggaggttccc

SEQ ID NO: 6763 - DNA, 22 bp, Artificial Sequence
  Description of Artificial Sequence: Synthetic oligonucleotide
actctgttttttttcccttccg

SEQ ID NO: 6764 - DNA, 20 bp, Artificial Sequence
  Description of Artificial Sequence: Synthetic oligonucleotide
actttttcattctctctgcc

SEQ ID NO: 6765 - DNA, 20 bp, Artificial Sequence
  Description of Artificial Sequence: Synthetic oligonucleotide
cctttcatgcattttctccg

SEQ ID NO: 6766 - DNA, 21 bp, Artificial Sequence
  Description of Artificial Sequence: Synthetic oligonucleotide
acatttcgttttttctcgccg

SEQ ID NO: 6767 - DNA, 20 bp, Artificial Sequence
  Description of Artificial Sequence: Synthetic oligonucleotide
ttttatttgccccttttccc

SEQ ID NO: 6768 - DNA, 20 bp, Artificial Sequence
  Description of Artificial Sequence: Synthetic oligonucleotide
acttttgatcttttacaccg

SEQ ID NO: 6769 - DNA, 20 bp, Artificial Sequence
  Description of Artificial Sequence: Synthetic oligonucleotide
atctttttctttttccacca

SEQ ID NO: 6770 - DNA, 20 bp, Artificial Sequence
  Description of Artificial Sequence: Synthetic oligonucleotide
atttctcttatttcctccgc

SEQ ID NO: 6771 - DNA, 20 bp, Artificial Sequence
  Description of Artificial Sequence: Synthetic oligonucleotide
atttccttttaccttcaccg

SEQ ID NO: 6772 - DNA, 20 bp, Artificial Sequence
  Description of Artificial Sequence: Synthetic oligonucleotide
tttcacctctttttctgccg

SEQ ID NO: 6773 - DNA, 21 bp, Artificial Sequence
  Description of Artificial Sequence: Synthetic oligonucleotide
ttactcattttattttctccg

SEQ ID NO: 6774 - DNA, 20 bp, Artificial Sequence
  Description of Artificial Sequence: Synthetic oligonucleotide
acgtttacattctttcaccg

SEQ ID NO: 6775 - DNA, 20 bp, Artificial Sequence
  Description of Artificial Sequence: Synthetic oligonucleotide
gcctttcgttcttttctccc

SEQ ID NO: 6776 - DNA, 20 bp, Artificial Sequence
  Description of Artificial Sequence: Synthetic oligonucleotide
cattctttgttgtttctcgc

SEQ ID NO: 6777 - DNA, 19 bp, Artificial Sequence
  Description of Artificial Sequence: Synthetic oligonucleotide
ttttatgttgatttgtgtg

SEQ ID NO: 6778 - DNA, 20 bp, Artificial Sequence
  Description of Artificial Sequence: Synthetic oligonucleotide
ttttatgggtgatgggtccg

SEQ ID NO: 6779 - DNA, 20 bp, Artificial Sequence
  Description of Artificial Sequence: Synthetic oligonucleotide
tcttcttgttactcgttccg

SEQ ID NO: 6780 - DNA, 20 bp, Artificial Sequence
  Description of Artificial Sequence: Synthetic oligonucleotide
gcctttcgttctaccttccc

SEQ ID NO: 6781 - DNA, 20 bp, Artificial Sequence
  Description of Artificial Sequence: Synthetic oligonucleotide
tatttacctttctttccccg

SEQ ID NO: 6782 - DNA, 20 bp, Artificial Sequence
  Description of Artificial Sequence: Synthetic oligonucleotide
ttacttatttcttctttgcc

SEQ ID NO: 6783 - DNA, 22 bp, Artificial Sequence
  Description of Artificial Sequence: Synthetic oligonucleotide
tttttcgtgtttttttgcacct

SEQ ID NO: 6784 - DNA, 20 bp, Artificial Sequence
  Description of Artificial Sequence: Synthetic oligonucleotide
gctgaagggtgatgggtccg

SEQ ID NO: 6785 - DNA, 19 bp, Artificial Sequence
  Description of Artificial Sequence: Synthetic oligonucleotide
ctttcactttttttctccg

SEQ ID NO: 6786 - DNA, 20 bp, Artificial Sequence
  Description of Artificial Sequence: Synthetic oligonucleotide
gttgatgggtgatgggtccg

SEQ ID NO: 6787 - DNA, 19 bp, Artificial Sequence
  Description of Artificial Sequence: Synthetic oligonucleotide
tattttcttcttttctccg

SEQ ID NO: 6788 - DNA, 20 bp, Artificial Sequence
  Description of Artificial Sequence: Synthetic oligonucleotide
ccttttactttttctctccg

SEQ ID NO: 6789 - DNA, 20 bp, Artificial Sequence
  Description of Artificial Sequence: Synthetic oligonucleotide
tcttgttttttttttgccgc

SEQ ID NO: 6790 - DNA, 20 bp, Artificial Sequence
  Description of Artificial Sequence: Synthetic oligonucleotide
gccgttcggtctgccctccc

SEQ ID NO: 6791 - DNA, 20 bp, Artificial Sequence
  Description of Artificial Sequence: Synthetic oligonucleotide
atcactctttctcttttgcc

SEQ ID NO: 6792 - DNA, 19 bp, Artificial Sequence
  Description of Artificial Sequence: Synthetic oligonucleotide
ttgggtgtagggtggtagc

SEQ ID NO: 6793 - DNA, 19 bp, Artificial Sequence
  Description of Artificial Sequence: Synthetic oligonucleotide
tttttgttttgttttggtg

SEQ ID NO: 6794 - DNA, 20 bp, Artificial Sequence
  Description of Artificial Sequence: Synthetic oligonucleotide
gctactttttactctttccg

SEQ ID NO: 6795 - DNA, 22 bp, Artificial Sequence
  Description of Artificial Sequence: Synthetic oligonucleotide
acattctctttttttttcaccg

SEQ ID NO: 6796 - DNA, 20 bp, Artificial Sequence
  Description of Artificial Sequence: Synthetic oligonucleotide
ccttttctgtcttctacccg

SEQ ID NO: 6797 - DNA, 20 bp, Artificial Sequence
  Description of Artificial Sequence: Synthetic oligonucleotide
actttaacattcttcttccg

SEQ ID NO: 6798 - DNA, 21 bp, Artificial Sequence
  Description of Artificial Sequence: Synthetic oligonucleotide
tcgttgtctttttttttgccc

SEQ ID NO: 6799 - DNA, 20 bp, Artificial Sequence
  Description of Artificial Sequence: Synthetic oligonucleotide
atttcctaatgcttctaccg

SEQ ID NO: 6800 - DNA, 22 bp, Artificial Sequence
  Description of Artificial Sequence: Synthetic oligonucleotide
gttccattttttttttccaccg

SEQ ID NO: 6801 - DNA, 22 bp, Artificial Sequence
  Description of Artificial Sequence: Synthetic oligonucleotide
tttttctcacaattctcatcct

SEQ ID NO: 6802 - DNA, 20 bp, Artificial Sequence
  Description of Artificial Sequence: Synthetic oligonucleotide
tttttattttcctggttccg

SEQ ID NO: 6803 - DNA, 20 bp, Artificial Sequence
  Description of Artificial Sequence: Synthetic oligonucleotide
gtttactttttctccattcc

SEQ ID NO: 6804 - DNA, 20 bp, Artificial Sequence
  Description of Artificial Sequence: Synthetic oligonucleotide
tgttttctctttgtttactg

SEQ ID NO: 6805 - DNA, 20 bp, Artificial Sequence
  Description of Artificial Sequence: Synthetic oligonucleotide
tttctttatatttatgcccc

SEQ ID NO: 6806 - DNA, 20 bp, Artificial Sequence
  Description of Artificial Sequence: Synthetic oligonucleotide
tcttttacaaacactctccg

SEQ ID NO: 6807 - DNA, 20 bp, Artificial Sequence
  Description of Artificial Sequence: Synthetic oligonucleotide
ccttaattttcactttcccg

SEQ ID NO: 6808 - DNA, 20 bp, Artificial Sequence
  Description of Artificial Sequence: Synthetic oligonucleotide
ttttctgttttgttcatccg

SEQ ID NO: 6809 - DNA, 21 bp, Artificial Sequence
  Description of Artificial Sequence: Synthetic oligonucleotide
agtttttatttctattttgcc

SEQ ID NO: 6810 - DNA, 21 bp, Artificial Sequence
  Description of Artificial Sequence: Synthetic oligonucleotide
tgttttagttctttttctcgc

SEQ ID NO: 6811 - DNA, 20 bp, Artificial Sequence
  Description of Artificial Sequence: Synthetic oligonucleotide
ccacttaaattttttctccg

SEQ ID NO: 6812 - DNA, 20 bp, Artificial Sequence
  Description of Artificial Sequence: Synthetic oligonucleotide
atcttactacttttctccgc

SEQ ID NO: 6813 - DNA, 20 bp, Artificial Sequence
  Description of Artificial Sequence: Synthetic oligonucleotide
tctttcactatttttatccc

SEQ ID NO: 6814 - DNA, 20 bp, Artificial Sequence
  Description of Artificial Sequence: Synthetic oligonucleotide
ccttacttactttacttccg

SEQ ID NO: 6815 - DNA, 21 bp, Artificial Sequence
  Description of Artificial Sequence: Synthetic oligonucleotide
acactttttttttcacttccc

SEQ ID NO: 6816 - DNA, 20 bp, Artificial Sequence
  Description of Artificial Sequence: Synthetic oligonucleotide
tttcttctatctttttcccc

SEQ ID NO: 6817 - DNA, 20 bp, Artificial Sequence
  Description of Artificial Sequence: Synthetic oligonucleotide
ccattttaattcttttaccg

SEQ ID NO: 6818 - DNA, 21 bp, Artificial Sequence
  Description of Artificial Sequence: Synthetic oligonucleotide
tctttttttttactttccccg

SEQ ID NO: 6819 - DNA, 21 bp, Artificial Sequence
  Description of Artificial Sequence: Synthetic oligonucleotide
ttatttacttccttttcacac

SEQ ID NO: 6820 - DNA, 20 bp, Artificial Sequence
  Description of Artificial Sequence: Synthetic oligonucleotide
attttgaccttttttacccg

SEQ ID NO: 6821 - DNA, 20 bp, Artificial Sequence
  Description of Artificial Sequence: Synthetic oligonucleotide
ttttttcttgactttatctg

SEQ ID NO: 6822 - DNA, 20 bp, Artificial Sequence
  Description of Artificial Sequence: Synthetic oligonucleotide
ttttgttctctattcctctg

SEQ ID NO: 6823 - DNA, 21 bp, Artificial Sequence
  Description of Artificial Sequence: Synthetic oligonucleotide
cttttttttcttttgttcccg

SEQ ID NO: 6824 - DNA, 20 bp, Artificial Sequence
  Description of Artificial Sequence: Synthetic oligonucleotide
ccacttacacactttttccg

SEQ ID NO: 6825 - DNA, 21 bp, Artificial Sequence
  Description of Artificial Sequence: Synthetic oligonucleotide
tttttctatcttttttgtccg

SEQ ID NO: 6826 - DNA, 21 bp, Artificial Sequence
  Description of Artificial Sequence: Synthetic oligonucleotide
atctttttttctcttaccgcc

SEQ ID NO: 6827 - DNA, 20 bp, Artificial Sequence
  Description of Artificial Sequence: Synthetic oligonucleotide
ggtttttcgctttatttccc

SEQ ID NO: 6828 - DNA, 20 bp, Artificial Sequence
  Description of Artificial Sequence: Synthetic oligonucleotide
tatcgcttactttatttccg

SEQ ID NO: 6829 - DNA, 20 bp, Artificial Sequence
  Description of Artificial Sequence: Synthetic oligonucleotide
gtttatttttttgtgttccg

SEQ ID NO: 6830 - DNA, 20 bp, Artificial Sequence
  Description of Artificial Sequence: Synthetic oligonucleotide
ttatatttcctcttcttccg

SEQ ID NO: 6831 - DNA, 20 bp, Artificial Sequence
  Description of Artificial Sequence: Synthetic oligonucleotide
tcttctactcattttttccg

SEQ ID NO: 6832 - DNA, 20 bp, Artificial Sequence
  Description of Artificial Sequence: Synthetic oligonucleotide
attttacttcactttgaccg

SEQ ID NO: 6833 - DNA, 20 bp, Artificial Sequence
  Description of Artificial Sequence: Synthetic oligonucleotide
attttactttcttcatcccg

SEQ ID NO: 6834 - DNA, 20 bp, Artificial Sequence
  Description of Artificial Sequence: Synthetic oligonucleotide
tctaactattctttcctccg

SEQ ID NO: 6835 - DNA, 20 bp, Artificial Sequence
  Description of Artificial Sequence: Synthetic oligonucleotide
gacctttcttgtttctaccc

SEQ ID NO: 6836 - DNA, 20 bp, Artificial Sequence
  Description of Artificial Sequence: Synthetic oligonucleotide
cttttcatttcaattctccg

SEQ ID NO: 6837 - DNA, 22 bp, Artificial Sequence
  Description of Artificial Sequence: Synthetic oligonucleotide
ctttgtctattttttttttccg

SEQ ID NO: 6838 - DNA, 20 bp, Artificial Sequence
  Description of Artificial Sequence: Synthetic oligonucleotide
tctttactatatttcacccg

SEQ ID NO: 6839 - DNA, 19 bp, Artificial Sequence
  Description of Artificial Sequence: Synthetic oligonucleotide
cttttctttctcttttccg

SEQ ID NO: 6840 - DNA, 20 bp, Artificial Sequence
  Description of Artificial Sequence: Synthetic oligonucleotide
acttttatccatttatcccg

SEQ ID NO: 6841 - DNA, 20 bp, Artificial Sequence
  Description of Artificial Sequence: Synthetic oligonucleotide
gaactctttttttttcgccc

SEQ ID NO: 6842 - DNA, 20 bp, Artificial Sequence
  Description of Artificial Sequence: Synthetic oligonucleotide
acttgttccttctttcgccg

SEQ ID NO: 6843 - DNA, 20 bp, Artificial Sequence
  Description of Artificial Sequence: Synthetic oligonucleotide
ctcttacacttcccttaccg

SEQ ID NO: 6844 - DNA, 20 bp, Artificial Sequence
  Description of Artificial Sequence: Synthetic oligonucleotide
gtttttcgttctgccctccc

SEQ ID NO: 6845 - DNA, 20 bp, Artificial Sequence
  Description of Artificial Sequence: Synthetic oligonucleotide
tgccgtagtctatccgcccg

SEQ ID NO: 6846 - DNA, 21 bp, Artificial Sequence
  Description of Artificial Sequence: Synthetic oligonucleotide
ttttatttctttttttccccc

SEQ ID NO: 6847 - DNA, 20 bp, Artificial Sequence
  Description of Artificial Sequence: Synthetic oligonucleotide
ccattttgtttttgtttccg

SEQ ID NO: 6848 - DNA, 20 bp, Artificial Sequence
  Description of Artificial Sequence: Synthetic oligonucleotide
tttctctttcttttctcccc

SEQ ID NO: 6849 - DNA, 20 bp, Artificial Sequence
  Description of Artificial Sequence: Synthetic oligonucleotide
accttattttttgtttgccg

SEQ ID NO: 6850 - DNA, 21 bp, Artificial Sequence
  Description of Artificial Sequence: Synthetic oligonucleotide
atttttactgttctctttccc

SEQ ID NO: 6851 - DNA, 20 bp, Artificial Sequence
  Description of Artificial Sequence: Synthetic oligonucleotide
cttttattatctctttccgc

SEQ ID NO: 6852 - DNA, 20 bp, Artificial Sequence
  Description of Artificial Sequence: Synthetic oligonucleotide
ttctcttctttctttccccg

SEQ ID NO: 6853 - DNA, 20 bp, Artificial Sequence
  Description of Artificial Sequence: Synthetic oligonucleotide
atttcaatcttttcctaccg

SEQ ID NO: 6854 - DNA, 20 bp, Artificial Sequence
  Description of Artificial Sequence: Synthetic oligonucleotide
ttttctatttctcttctgta

SEQ ID NO: 6855 - DNA, 20 bp, Artificial Sequence
  Description of Artificial Sequence: Synthetic oligonucleotide
catttctattattccctcgc

SEQ ID NO: 6856 - DNA, 20 bp, Artificial Sequence
  Description of Artificial Sequence: Synthetic oligonucleotide
ttattattcttttcttcgcc

SEQ ID NO: 6857 - DNA, 21 bp, Artificial Sequence
  Description of Artificial Sequence: Synthetic oligonucleotide
tttctcttttttctctttccg

SEQ ID NO: 6858 - DNA, 20 bp, Artificial Sequence
  Description of Artificial Sequence: Synthetic oligonucleotide
ctttttcacgttttttcctg

SEQ ID NO: 6859 - DNA, 19 bp, Artificial Sequence
  Description of Artificial Sequence: Synthetic oligonucleotide
tttttgtttgtttttggtg

SEQ ID NO: 6860 - DNA, 20 bp, Artificial Sequence
  Description of Artificial Sequence: Synthetic oligonucleotide
aattatcctttttcaccccg

SEQ ID NO: 6861 - DNA, 19 bp, Artificial Sequence
  Description of Artificial Sequence: Synthetic oligonucleotide
tttctttttatttcccctg

SEQ ID NO: 6862 - DNA, 20 bp, Artificial Sequence
  Description of Artificial Sequence: Synthetic oligonucleotide
cctatacctgtttctttccg

SEQ ID NO: 6863 - DNA, 20 bp, Artificial Sequence
  Description of Artificial Sequence: Synthetic oligonucleotide
tttttcttttcccttgtccg

SEQ ID NO: 6864 - DNA, 19 bp, Artificial Sequence
  Description of Artificial Sequence: Synthetic oligonucleotide
tttctctttttctcttccg

SEQ ID NO: 6865 - DNA, 20 bp, Artificial Sequence
  Description of Artificial Sequence: Synthetic oligonucleotide
ttttttttcctgcttgtccg

SEQ ID NO: 6866 - DNA, 20 bp, Artificial Sequence
  Description of Artificial Sequence: Synthetic oligonucleotide
tcctttcgttttgccctccc

SEQ ID NO: 6867 - DNA, 20 bp, Artificial Sequence
  Description of Artificial Sequence: Synthetic oligonucleotide
tttgtagggtcatgggtccg

SEQ ID NO: 6868 - DNA, 20 bp, Artificial Sequence
  Description of Artificial Sequence: Synthetic oligonucleotide
tttcaagggcgatgggtccg

SEQ ID NO: 6869 - DNA, 20 bp, Artificial Sequence
  Description of Artificial Sequence: Synthetic oligonucleotide
tcatctttttacttcctgtg

SEQ ID NO: 6870 - DNA, 19 bp, Artificial Sequence
  Description of Artificial Sequence: Synthetic oligonucleotide
attttctttttgcttgccg

SEQ ID NO: 6871 - DNA, 19 bp, Artificial Sequence
  Description of Artificial Sequence: Synthetic oligonucleotide
ttttttttgtcttgctccg

SEQ ID NO: 6872 - DNA, 20 bp, Artificial Sequence
  Description of Artificial Sequence: Synthetic oligonucleotide
ctccattctatctttttccg

SEQ ID NO: 6873 - DNA, 20 bp, Artificial Sequence
  Description of Artificial Sequence: Synthetic oligonucleotide
attccttttcctttttaccg

SEQ ID NO: 6874 - DNA, 19 bp, Artificial Sequence
  Description of Artificial Sequence: Synthetic oligonucleotide
atttctcttttttctgccg

SEQ ID NO: 6875 - DNA, 22 bp, Artificial Sequence
  Description of Artificial Sequence: Synthetic oligonucleotide
gaactctttttttttttcgccc

SEQ ID NO: 6876 - DNA, 20 bp, Artificial Sequence
  Description of Artificial Sequence: Synthetic oligonucleotide
tttgaagggttttgggtccg

SEQ ID NO: 6877 - DNA, 21 bp, Artificial Sequence
  Description of Artificial Sequence: Synthetic oligonucleotide
tttctctacgttttctgtccg

SEQ ID NO: 6878 - DNA, 20 bp, Artificial Sequence
  Description of Artificial Sequence: Synthetic oligonucleotide
ttattcttgttttacccctg

SEQ ID NO: 6879 - DNA, 21 bp, Artificial Sequence
  Description of Artificial Sequence: Synthetic oligonucleotide
tttttgttcttttttcttccg

SEQ ID NO: 6880 - DNA, 20 bp, Artificial Sequence
  Description of Artificial Sequence: Synthetic oligonucleotide
ccttttgtattgttattccg

SEQ ID NO: 6881 - DNA, 21 bp, Artificial Sequence
  Description of Artificial Sequence: Synthetic oligonucleotide
tctgctctttttttttccccc

SEQ ID NO: 6882 - DNA, 21 bp, Artificial Sequence
  Description of Artificial Sequence: Synthetic oligonucleotide
agtttttttaatttctgtccc

SEQ ID NO: 6883 - DNA, 20 bp, Artificial Sequence
  Description of Artificial Sequence: Synthetic oligonucleotide
tcactaattcttttcttccg

SEQ ID NO: 6884 - DNA, 21 bp, Artificial Sequence
  Description of Artificial Sequence: Synthetic oligonucleotide
ttttctacacttctttttccg

SEQ ID NO: 6885 - DNA, 20 bp, Artificial Sequence
  Description of Artificial Sequence: Synthetic oligonucleotide
ttttatccttctactgcccg

SEQ ID NO: 6886 - DNA, 20 bp, Artificial Sequence
  Description of Artificial Sequence: Synthetic oligonucleotide
tttcttttttcttacttgcc

SEQ ID NO: 6887 - DNA, 22 bp, Artificial Sequence
  Description of Artificial Sequence: Synthetic oligonucleotide
ttctagcttctttttttgtccg

SEQ ID NO: 6888 - DNA, 19 bp, Artificial Sequence
  Description of Artificial Sequence: Synthetic oligonucleotide
ttttattttcttttccccg

SEQ ID NO: 6889 - DNA, 20 bp, Artificial Sequence
  Description of Artificial Sequence: Synthetic oligonucleotide
acattctttatttaccaccg

SEQ ID NO: 6890 - DNA, 20 bp, Artificial Sequence
  Description of Artificial Sequence: Synthetic oligonucleotide
tctttttgtttgttttgctc

SEQ ID NO: 6891 - DNA, 20 bp, Artificial Sequence
  Description of Artificial Sequence: Synthetic oligonucleotide
tttgtgagtagggtgttccg

SEQ ID NO: 6892 - DNA, 21 bp, Artificial Sequence
  Description of Artificial Sequence: Synthetic oligonucleotide
tcacatctaattttttctccg

SEQ ID NO: 6893 - DNA, 21 bp, Artificial Sequence
  Description of Artificial Sequence: Synthetic oligonucleotide
ttacttggttatttttttctg

SEQ ID NO: 6894 - DNA, 21 bp, Artificial Sequence
  Description of Artificial Sequence: Synthetic oligonucleotide
tttgaagggtgatagggtcct

SEQ ID NO: 6895 - DNA, 19 bp, Artificial Sequence
  Description of Artificial Sequence: Synthetic oligonucleotide
ctcatttcttctctttccg

SEQ ID NO: 6896 - DNA, 20 bp, Artificial Sequence
  Description of Artificial Sequence: Synthetic oligonucleotide
tttgaagggtgattgggccg

SEQ ID NO: 6897 - DNA, 22 bp, Artificial Sequence
  Description of Artificial Sequence: Synthetic oligonucleotide
ctttcatttttttttcgtaccg

SEQ ID NO: 6898 - DNA, 21 bp, Artificial Sequence
  Description of Artificial Sequence: Synthetic oligonucleotide
ttttttgttttgtttttggtg

SEQ ID NO: 6899 - DNA, 20 bp, Artificial Sequence
  Description of Artificial Sequence: Synthetic oligonucleotide
tttgggagtcgggtgttccg

SEQ ID NO: 6900 - DNA, 20 bp, Artificial Sequence
  Description of Artificial Sequence: Synthetic oligonucleotide
ttcctgtgttctccctgccc

SEQ ID NO: 6901 - DNA, 20 bp, Artificial Sequence
  Description of Artificial Sequence: Synthetic oligonucleotide
gtcttcttgcttatcgtccc

SEQ ID NO: 6902 - DNA, 21 bp, Artificial Sequence
  Description of Artificial Sequence: Synthetic oligonucleotide
tttgaaggggtgatgggtccc

SEQ ID NO: 6903 - DNA, 20 bp, Artificial Sequence
  Description of Artificial Sequence: Synthetic oligonucleotide
tatatgttcgtcactcgctg

SEQ ID NO: 6904 - DNA, 19 bp, Artificial Sequence
  Description of Artificial Sequence: Synthetic oligonucleotide
aagggtgtagggtgttccg

SEQ ID NO: 6905 - DNA, 19 bp, Artificial Sequence
  Description of Artificial Sequence: Synthetic oligonucleotide
attccttttctctttgccg

SEQ ID NO: 6906 - DNA, 20 bp, Artificial Sequence
  Description of Artificial Sequence: Synthetic oligonucleotide
ttctctccctgttgtgtccg

SEQ ID NO: 6907 - DNA, 20 bp, Artificial Sequence
  Description of Artificial Sequence: Synthetic oligonucleotide
tttgaaggggaatgggtccg

SEQ ID NO: 6908 - DNA, 20 bp, Artificial Sequence
  Description of Artificial Sequence: Synthetic oligonucleotide
ctttttcttttcttgttccg

SEQ ID NO: 6909 - DNA, 20 bp, Artificial Sequence
  Description of Artificial Sequence: Synthetic oligonucleotide
tcttttcatgtttccctccg

SEQ ID NO: 6910 - DNA, 20 bp, Artificial Sequence
  Description of Artificial Sequence: Synthetic oligonucleotide
tcatttctttacttctaccg

SEQ ID NO: 6911 - DNA, 19 bp, Artificial Sequence
  Description of Artificial Sequence: Synthetic oligonucleotide
attttctctttgcttgccg

SEQ ID NO: 6912 - DNA, 20 bp, Artificial Sequence
  Description of Artificial Sequence: Synthetic oligonucleotide
tcacgtattttttacgggtg

SEQ ID NO: 6913 - DNA, 20 bp, Artificial Sequence
  Description of Artificial Sequence: Synthetic oligonucleotide
tcctgtcgtctgtccttccc

SEQ ID NO: 6914 - DNA, 19 bp, Artificial Sequence
  Description of Artificial Sequence: Synthetic oligonucleotide
gcctttcgttttgcctccc

SEQ ID NO: 6915 - DNA, 21 bp, Artificial Sequence
  Description of Artificial Sequence: Synthetic oligonucleotide
gtcctgccgtctgttcgtccc

SEQ ID NO: 6916 - DNA, 19 bp, Artificial Sequence
  Description of Artificial Sequence: Synthetic oligonucleotide
gccttcgttctaccctccc

SEQ ID NO: 6917 - DNA, 20 bp, Artificial Sequence
  Description of Artificial Sequence: Synthetic oligonucleotide
cgatttctctggttcgtccc

SEQ ID NO: 6918 - DNA, 20 bp, Artificial Sequence
  Description of Artificial Sequence: Synthetic oligonucleotide
ccagtgaacttgatgtgccc

SEQ ID NO: 6919 - DNA, 19 bp, Artificial Sequence
  Description of Artificial Sequence: Synthetic oligonucleotide
cgattcctctgttcgtccc

SEQ ID NO: 6920 - DNA, 20 bp, Artificial Sequence
  Description of Artificial Sequence: Synthetic oligonucleotide
tcttttcatgtttctctccc

SEQ ID NO: 6921 - DNA, 20 bp, Artificial Sequence
  Description of Artificial Sequence: Synthetic oligonucleotide
tcccctgagtttctgctgcc

SEQ ID NO: 6922 - DNA, 20 bp, Artificial Sequence
  Description of Artificial Sequence: Synthetic oligonucleotide
tggttttctcttcttttgcc

SEQ ID NO: 6923 - DNA, 21 bp, Artificial Sequence
  Description of Artificial Sequence: Synthetic oligonucleotide
tacttctttttttcctctccg

SEQ ID NO: 6924 - DNA, 20 bp, Artificial Sequence
  Description of Artificial Sequence: Synthetic oligonucleotide
tttcctttttctcttgtcgg

SEQ ID NO: 6925 - DNA, 20 bp, Artificial Sequence
  Description of Artificial Sequence: Synthetic oligonucleotide
gtttacttctttctctgctg

SEQ ID NO: 6926 - DNA, 22 bp, Artificial Sequence
  Description of Artificial Sequence: Synthetic oligonucleotide
aattatgttttttttgtgacct

SEQ ID NO: 6927 - DNA, 20 bp, Artificial Sequence
  Description of Artificial Sequence: Synthetic oligonucleotide
ttttatccttttccgctccg

SEQ ID NO: 6928 - DNA, 20 bp, Artificial Sequence
  Description of Artificial Sequence: Synthetic oligonucleotide
ctttttgattcttgtttccg

SEQ ID NO: 6929 - DNA, 19 bp, Artificial Sequence
  Description of Artificial Sequence: Synthetic oligonucleotide
ctctttcttcttttctccg

SEQ ID NO: 6930 - DNA, 20 bp, Artificial Sequence
  Description of Artificial Sequence: Synthetic oligonucleotide
gcctttcgttcttgcctccc

SEQ ID NO: 6931 - DNA, 20 bp, Artificial Sequence
  Description of Artificial Sequence: Synthetic oligonucleotide
gccctgtcgtcttacgtccc

SEQ ID NO: 6932 - DNA, 19 bp, Artificial Sequence
  Description of Artificial Sequence: Synthetic oligonucleotide
tctttactttctcttgccg

SEQ ID NO: 6933 - DNA, 20 bp, Artificial Sequence
  Description of Artificial Sequence: Synthetic oligonucleotide
actttcatatttttccaccg

SEQ ID NO: 6934 - DNA, 19 bp, Artificial Sequence
  Description of Artificial Sequence: Synthetic oligonucleotide
cttttcgttctgccctccc

SEQ ID NO: 6935 - DNA, 20 bp, Artificial Sequence
  Description of Artificial Sequence: Synthetic oligonucleotide
tgtttattttctccgtgccc

SEQ ID NO: 6936 - DNA, 20 bp, Artificial Sequence
  Description of Artificial Sequence: Synthetic oligonucleotide
tctttttattctctcccccc

SEQ ID NO: 6937 - DNA, 20 bp, Artificial Sequence
  Description of Artificial Sequence: Synthetic oligonucleotide
cctttgatcctttttctccg

SEQ ID NO: 6938 - DNA, 19 bp, Artificial Sequence
  Description of Artificial Sequence: Synthetic oligonucleotide
tttgggagtagggtctccg

SEQ ID NO: 6939 - DNA, 20 bp, Artificial Sequence
  Description of Artificial Sequence: Synthetic oligonucleotide
tctctttacttccttttccg

SEQ ID NO: 6940 - DNA, 20 bp, Artificial Sequence
  Description of Artificial Sequence: Synthetic oligonucleotide
tgactcgtctttttcgtccc

SEQ ID NO: 6941 - DNA, 20 bp, Artificial Sequence
  Description of Artificial Sequence: Synthetic oligonucleotide
attctcttctcttttcaccg

SEQ ID NO: 6942 - DNA, 20 bp, Artificial Sequence
  Description of Artificial Sequence: Synthetic oligonucleotide
cgcttttcttacttcttccg

SEQ ID NO: 6943 - DNA, 19 bp, Artificial Sequence
  Description of Artificial Sequence: Synthetic oligonucleotide
ctttctcttgctctttccg

SEQ ID NO: 6944 - DNA, 19 bp, Artificial Sequence
  Description of Artificial Sequence: Synthetic oligonucleotide
tttacttttactcttgccc

SEQ ID NO: 6945 - DNA, 20 bp, Artificial Sequence
  Description of Artificial Sequence: Synthetic oligonucleotide
ctttattatccttttttccc

SEQ ID NO: 6946 - DNA, 20 bp, Artificial Sequence
  Description of Artificial Sequence: Synthetic oligonucleotide
ctctttatttccttgccccg

SEQ ID NO: 6947 - DNA, 19 bp, Artificial Sequence
  Description of Artificial Sequence: Synthetic oligonucleotide
tttctttgctttctctccg

SEQ ID NO: 6948 - DNA, 20 bp, Artificial Sequence
  Description of Artificial Sequence: Synthetic oligonucleotide
atttcccctttcttttgccg

SEQ ID NO: 6949 - DNA, 18 bp, Artificial Sequence
  Description of Artificial Sequence: Synthetic oligonucleotide
tttggggttttcgtgccg

SEQ ID NO: 6950 - DNA, 19 bp, Artificial Sequence
  Description of Artificial Sequence: Synthetic oligonucleotide
atccttttgctttctaccg

SEQ ID NO: 6951 - DNA, 20 bp, Artificial Sequence
  Description of Artificial Sequence: Synthetic oligonucleotide
tcctttattgttttctcctg

SEQ ID NO: 6952 - DNA, 20 bp, Artificial Sequence
  Description of Artificial Sequence: Synthetic oligonucleotide
tattcttctatacctctccg

SEQ ID NO: 6953 - DNA, 21 bp, Artificial Sequence
  Description of Artificial Sequence: Synthetic oligonucleotide
gtttccttgtttcttgttccg

SEQ ID NO: 6954 - DNA, 20 bp, Artificial Sequence
  Description of Artificial Sequence: Synthetic oligonucleotide
cttttccagtctttttcccg

SEQ ID NO: 6955 - DNA, 20 bp, Artificial Sequence
  Description of Artificial Sequence: Synthetic oligonucleotide
tttctcttgcttactccccg

SEQ ID NO: 6956 - DNA, 20 bp, Artificial Sequence
  Description of Artificial Sequence: Synthetic oligonucleotide
attgaagggtgatgggtccc

SEQ ID NO: 6957 - DNA, 20 bp, Artificial Sequence
  Description of Artificial Sequence: Synthetic oligonucleotide
tttggggtcttcccgtgccg

SEQ ID NO: 6958 - DNA, 20 bp, Artificial Sequence
  Description of Artificial Sequence: Synthetic oligonucleotide
gcctttcgctctaccctccc

SEQ ID NO: 6959 - DNA, 20 bp, Artificial Sequence
  Description of Artificial Sequence: Synthetic oligonucleotide
gtcttttggcttatcgtccc

SEQ ID NO: 6960 - DNA, 19 bp, Artificial Sequence
  Description of Artificial Sequence: Synthetic oligonucleotide
attcttttctctttcaccg

SEQ ID NO: 6961 - DNA, 22 bp, Artificial Sequence
  Description of Artificial Sequence: Synthetic oligonucleotide
cttttccttttttttcactccg

SEQ ID NO: 6962 - DNA, 20 bp, Artificial Sequence
  Description of Artificial Sequence: Synthetic oligonucleotide
tctttactttttctttgccg

SEQ ID NO: 6963 - DNA, 20 bp, Artificial Sequence
  Description of Artificial Sequence: Synthetic oligonucleotide
tttgaagggacatgggtccg

SEQ ID NO: 6964 - DNA, 19 bp, Artificial Sequence
  Description of Artificial Sequence: Synthetic oligonucleotide
ctttcactttttctctccg

SEQ ID NO: 6965 - DNA, 20 bp, Artificial Sequence
  Description of Artificial Sequence: Synthetic oligonucleotide
tttgcagggtgttgggtccg

SEQ ID NO: 6966 - DNA, 20 bp, Artificial Sequence
  Description of Artificial Sequence: Synthetic oligonucleotide
atcctttctttcttctgccg

SEQ ID NO: 6967 - DNA, 20 bp, Artificial Sequence
  Description of Artificial Sequence: Synthetic oligonucleotide
tcttttcatgtctctctccg

SEQ ID NO: 6968 - DNA, 20 bp, Artificial Sequence
  Description of Artificial Sequence: Synthetic oligonucleotide
tttgaagggtattgggtccg

SEQ ID NO: 6969 - DNA, 20 bp, Artificial Sequence
  Description of Artificial Sequence: Synthetic oligonucleotide
tgttatttccctcttctccg

SEQ ID NO: 6970 - DNA, 20 bp, Artificial Sequence
  Description of Artificial Sequence: Synthetic oligonucleotide
gcctttcgttctttcctccc

SEQ ID NO: 6971 - DNA, 20 bp, Artificial Sequence
  Description of Artificial Sequence: Synthetic oligonucleotide
ttcttttctcagctcttccg

SEQ ID NO: 6972 - DNA, 19 bp, Artificial Sequence
  Description of Artificial Sequence: Synthetic oligonucleotide
ctctttttccctttctccg

SEQ ID NO: 6973 - DNA, 20 bp, Artificial Sequence
  Description of Artificial Sequence: Synthetic oligonucleotide
tgttttgttctccctggccg

SEQ ID NO: 6974 - DNA, 20 bp, Artificial Sequence
  Description of Artificial Sequence: Synthetic oligonucleotide
cttggagggtgatgggtccg

SEQ ID NO: 6975 - DNA, 18 bp, Artificial Sequence
  Description of Artificial Sequence: Synthetic oligonucleotide
tcttttcttctcttaccg

SEQ ID NO: 6976 - DNA, 20 bp, Artificial Sequence
  Description of Artificial Sequence: Synthetic oligonucleotide
agttgtttaatttgtttgcc

SEQ ID NO: 6977 - DNA, 20 bp, Artificial Sequence
  Description of Artificial Sequence: Synthetic oligonucleotide
tttcctttcacctttccccc

SEQ ID NO: 6978 - DNA, 21 bp, Artificial Sequence
  Description of Artificial Sequence: Synthetic oligonucleotide
attctgtttttcttgttaccg

SEQ ID NO: 6979 - DNA, 20 bp, Artificial Sequence
  Description of Artificial Sequence: Synthetic oligonucleotide
atttcttctcctcttctccg

SEQ ID NO: 6980 - DNA, 20 bp, Artificial Sequence
  Description of Artificial Sequence: Synthetic oligonucleotide
ttttattacttttccctggc

SEQ ID NO: 6981 - DNA, 18 bp, Artificial Sequence
  Description of Artificial Sequence: Synthetic oligonucleotide
ttgaagggtgatggtccg

SEQ ID NO: 6982 - DNA, 19 bp, Artificial Sequence
  Description of Artificial Sequence: Synthetic oligonucleotide
ttcatttcttttctctccg

SEQ ID NO: 6983 - DNA, 21 bp, Artificial Sequence
  Description of Artificial Sequence: Synthetic oligonucleotide
tttgggagtagggtgtttccg

SEQ ID NO: 6984 - DNA, 20 bp, Artificial Sequence
  Description of Artificial Sequence: Synthetic oligonucleotide
cattttctgttttttcggcc

SEQ ID NO: 6985 - DNA, 19 bp, Artificial Sequence
  Description of Artificial Sequence: Synthetic oligonucleotide
tttatcaagtttttttccg

SEQ ID NO: 6986 - DNA, 20 bp, Artificial Sequence
  Description of Artificial Sequence: Synthetic oligonucleotide
tttgtctttgtttttgtccg

SEQ ID NO: 6987 - DNA, 22 bp, Artificial Sequence
  Description of Artificial Sequence: Synthetic oligonucleotide
ttattgctttttttttggtccg

SEQ ID NO: 6988 - DNA, 19 bp, Artificial Sequence
  Description of Artificial Sequence: Synthetic oligonucleotide
tttattttctgttgttgtg

SEQ ID NO: 6989 - DNA, 20 bp, Artificial Sequence
  Description of Artificial Sequence: Synthetic oligonucleotide
gctggtgtaggggggttccg

SEQ ID NO: 6990 - DNA, 20 bp, Artificial Sequence
  Description of Artificial Sequence: Synthetic oligonucleotide
ccattctttctctgcttccg

SEQ ID NO: 6991 - DNA, 20 bp, Artificial Sequence
  Description of Artificial Sequence: Synthetic oligonucleotide
cttgtttcttcctattaccg

SEQ ID NO: 6992 - DNA, 20 bp, Artificial Sequence
  Description of Artificial Sequence: Synthetic oligonucleotide
tatttacgttctattctccg

SEQ ID NO: 6993 - DNA, 20 bp, Artificial Sequence
  Description of Artificial Sequence: Synthetic oligonucleotide
tctttattacattctttgcg

SEQ ID NO: 6994 - DNA, 20 bp, Artificial Sequence
  Description of Artificial Sequence: Synthetic oligonucleotide
ttcttgtttttactcatccc

SEQ ID NO: 6995 - DNA, 20 bp, Artificial Sequence
  Description of Artificial Sequence: Synthetic oligonucleotide
cttacatttccctttttccg

SEQ ID NO: 6996 - DNA, 20 bp, Artificial Sequence
  Description of Artificial Sequence: Synthetic oligonucleotide
tactatatcttttttcgctg

SEQ ID NO: 6997 - DNA, 22 bp, Artificial Sequence
  Description of Artificial Sequence: Synthetic oligonucleotide
attgcgtacttttttttttccg

SEQ ID NO: 6998 - DNA, 20 bp, Artificial Sequence
  Description of Artificial Sequence: Synthetic oligonucleotide
attctttaactctcttcccg

SEQ ID NO: 6999 - DNA, 21 bp, Artificial Sequence
  Description of Artificial Sequence: Synthetic oligonucleotide
aatttgcttcttttttatccg

SEQ ID NO: 7000 - DNA, 20 bp, Artificial Sequence
  Description of Artificial Sequence: Synthetic oligonucleotide
tgttctattcgctctttccg

SEQ ID NO: 7001 - DNA, 20 bp, Artificial Sequence
  Description of Artificial Sequence: Synthetic oligonucleotide
attacttaccttcttttgcc

SEQ ID NO: 7002 - DNA, 20 bp, Artificial Sequence
  Description of Artificial Sequence: Synthetic oligonucleotide
cttcgttaaattttcctccg

SEQ ID NO: 7003 - DNA, 20 bp, Artificial Sequence
  Description of Artificial Sequence: Synthetic oligonucleotide
ctctttgttttttcttgctg

SEQ ID NO: 7004 - DNA, 20 bp, Artificial Sequence
  Description of Artificial Sequence: Synthetic oligonucleotide
gaaggaggagttgggatctg

SEQ ID NO: 7005 - DNA, 19 bp, Artificial Sequence
  Description of Artificial Sequence: Synthetic oligonucleotide
tctttttcatttgtttccc

SEQ ID NO: 7006 - DNA, 20 bp, Artificial Sequence
  Description of Artificial Sequence: Synthetic oligonucleotide
tttactattttattgccccg

SEQ ID NO: 7007 - DNA, 20 bp, Artificial Sequence
  Description of Artificial Sequence: Synthetic oligonucleotide
tacctttgtaattttttccg

SEQ ID NO: 7008 - DNA, 20 bp, Artificial Sequence
  Description of Artificial Sequence: Synthetic oligonucleotide
gctttttacatttctcaccc

SEQ ID NO: 7009 - DNA, 20 bp, Artificial Sequence
  Description of Artificial Sequence: Synthetic oligonucleotide
gatttctcctcttttatccg

SEQ ID NO: 7010 - DNA, 20 bp, Artificial Sequence
  Description of Artificial Sequence: Synthetic oligonucleotide
cttttcaattccttttaccc

SEQ ID NO: 7011 - DNA, 20 bp, Artificial Sequence
  Description of Artificial Sequence: Synthetic oligonucleotide
ttttcattttatcctctgtg

SEQ ID NO: 7012 - DNA, 21 bp, Artificial Sequence
  Description of Artificial Sequence: Synthetic oligonucleotide
tctttttttgtttttctgcct

SEQ ID NO: 7013 - DNA, 21 bp, Artificial Sequence
  Description of Artificial Sequence: Synthetic oligonucleotide
acatctttttttcttttgcgc

SEQ ID NO: 7014 - DNA, 20 bp, Artificial Sequence
  Description of Artificial Sequence: Synthetic oligonucleotide
ttttctcaatttatttcccg

SEQ ID NO: 7015 - DNA, 20 bp, Artificial Sequence
  Description of Artificial Sequence: Synthetic oligonucleotide
atttcatctttacttctctg

SEQ ID NO: 7016 - DNA, 20 bp, Artificial Sequence
  Description of Artificial Sequence: Synthetic oligonucleotide
attttcatttccctttaccg

SEQ ID NO: 7017 - DNA, 20 bp, Artificial Sequence
  Description of Artificial Sequence: Synthetic oligonucleotide
ctttttactatccttttctg

SEQ ID NO: 7018 - DNA, 20 bp, Artificial Sequence
  Description of Artificial Sequence: Synthetic oligonucleotide
ttatttcttctacccctccg

SEQ ID NO: 7019 - DNA, 21 bp, Artificial Sequence
  Description of Artificial Sequence: Synthetic oligonucleotide
tctaatttttacctccttccg

SEQ ID NO: 7020 - DNA, 20 bp, Artificial Sequence
  Description of Artificial Sequence: Synthetic oligonucleotide
ctttcaacttttttccgcgt

SEQ ID NO: 7021 - DNA, 20 bp, Artificial Sequence
  Description of Artificial Sequence: Synthetic oligonucleotide
atttatttttgcccttacca

SEQ ID NO: 7022 - DNA, 20 bp, Artificial Sequence
  Description of Artificial Sequence: Synthetic oligonucleotide
tttttctttaatttgtgccc

SEQ ID NO: 7023 - DNA, 20 bp, Artificial Sequence
  Description of Artificial Sequence: Synthetic oligonucleotide
cattcactattctttttccg

SEQ ID NO: 7024 - DNA, 20 bp, Artificial Sequence
  Description of Artificial Sequence: Synthetic oligonucleotide
ttcttatattccgcttcccg

SEQ ID NO: 7025 - DNA, 20 bp, Artificial Sequence
  Description of Artificial Sequence: Synthetic oligonucleotide
tatttttccttttctggccc

SEQ ID NO: 7026 - DNA, 20 bp, Artificial Sequence
  Description of Artificial Sequence: Synthetic oligonucleotide
gtttcctttagtcttttccg

SEQ ID NO: 7027 - DNA, 20 bp, Artificial Sequence
  Description of Artificial Sequence: Synthetic oligonucleotide
ttcatttattttactttgcc

SEQ ID NO: 7028 - DNA, 20 bp, Artificial Sequence
  Description of Artificial Sequence: Synthetic oligonucleotide
tatcttgttatttcttcctg

SEQ ID NO: 7029 - DNA, 20 bp, Artificial Sequence
  Description of Artificial Sequence: Synthetic oligonucleotide
tttctttttagttctttccg

SEQ ID NO: 7030 - DNA, 22 bp, Artificial Sequence
  Description of Artificial Sequence: Synthetic oligonucleotide
ttatatgtcttttttttgtctg

SEQ ID NO: 7031 - DNA, 20 bp, Artificial Sequence
  Description of Artificial Sequence: Synthetic oligonucleotide
gactttactcttcttttccc

SEQ ID NO: 7032 - DNA, 20 bp, Artificial Sequence
  Description of Artificial Sequence: Synthetic oligonucleotide
atctctttgctcttataccg

SEQ ID NO: 7033 - DNA, 20 bp, Artificial Sequence
  Description of Artificial Sequence: Synthetic oligonucleotide
tttacaattttctcttgccg

SEQ ID NO: 7034 - DNA, 20 bp, Artificial Sequence
  Description of Artificial Sequence: Synthetic oligonucleotide
acttctatttctctcttgcc

SEQ ID NO: 7035 - DNA, 20 bp, Artificial Sequence
  Description of Artificial Sequence: Synthetic oligonucleotide
tctttattctgtcttctctg

SEQ ID NO: 7036 - DNA, 20 bp, Artificial Sequence
  Description of Artificial Sequence: Synthetic oligonucleotide
cttacttatatctttctccg

SEQ ID NO: 7037 - DNA, 20 bp, Artificial Sequence
  Description of Artificial Sequence: Synthetic oligonucleotide
ccttttcatttctcttcctg

SEQ ID NO: 7038 - DNA, 21 bp, Artificial Sequence
  Description of Artificial Sequence: Synthetic oligonucleotide
tatttattttttcttgcccct

SEQ ID NO: 7039 - DNA, 20 bp, Artificial Sequence
  Description of Artificial Sequence: Synthetic oligonucleotide
ctttattttaattccccccg

SEQ ID NO: 7040 - DNA, 20 bp, Artificial Sequence
  Description of Artificial Sequence: Synthetic oligonucleotide
cataggagtagggcggtagc

SEQ ID NO: 7041 - DNA, 20 bp, Artificial Sequence
  Description of Artificial Sequence: Synthetic oligonucleotide
ttttatgcttttaccttccg

SEQ ID NO: 7042 - DNA, 20 bp, Artificial Sequence
  Description of Artificial Sequence: Synthetic oligonucleotide
ctacatactttcttcttccg

SEQ ID NO: 7043 - DNA, 18 bp, Artificial Sequence
  Description of Artificial Sequence: Synthetic oligonucleotide
ccttttgtaatctttccg

SEQ ID NO: 7044 - DNA, 20 bp, Artificial Sequence
  Description of Artificial Sequence: Synthetic oligonucleotide
gccttttgtaattttttccc

SEQ ID NO: 7045 - DNA, 21 bp, Artificial Sequence
  Description of Artificial Sequence: Synthetic oligonucleotide
atttgttatgtttttgtaccg

SEQ ID NO: 7046 - DNA, 20 bp, Artificial Sequence
  Description of Artificial Sequence: Synthetic oligonucleotide
tttatttattttactctcca

SEQ ID NO: 7047 - DNA, 20 bp, Artificial Sequence
  Description of Artificial Sequence: Synthetic oligonucleotide
tcttcactttttatgttccg

SEQ ID NO: 7048 - DNA, 22 bp, Artificial Sequence
  Description of Artificial Sequence: Synthetic oligonucleotide
tttccctttttgttacttgccg

SEQ ID NO: 7049 - DNA, 20 bp, Artificial Sequence
  Description of Artificial Sequence: Synthetic oligonucleotide
ttgtactcttctctttcccg

SEQ ID NO: 7050 - DNA, 20 bp, Artificial Sequence
  Description of Artificial Sequence: Synthetic oligonucleotide
atctatacttactctcaccg

SEQ ID NO: 7051 - DNA, 22 bp, Artificial Sequence
  Description of Artificial Sequence: Synthetic oligonucleotide
tttgtttattcttttttttccg

SEQ ID NO: 7052 - DNA, 20 bp, Artificial Sequence
  Description of Artificial Sequence: Synthetic oligonucleotide
atttcatctttcttttgcca

SEQ ID NO: 7053 - DNA, 20 bp, Artificial Sequence
  Description of Artificial Sequence: Synthetic oligonucleotide
atgtggtgtttgcttagctg

SEQ ID NO: 7054 - DNA, 20 bp, Artificial Sequence
  Description of Artificial Sequence: Synthetic oligonucleotide
ttttttgattttccggtctg

SEQ ID NO: 7055 - DNA, 20 bp, Artificial Sequence
  Description of Artificial Sequence: Synthetic oligonucleotide
atctttcactattcactccg

SEQ ID NO: 7056 - DNA, 19 bp, Artificial Sequence
  Description of Artificial Sequence: Synthetic oligonucleotide
tcctgtcgtctgttcttcc

SEQ ID NO: 7057 - DNA, 18 bp, Artificial Sequence
  Description of Artificial Sequence: Synthetic oligonucleotide
gcctttcgtctccctccc

SEQ ID NO: 7058 - DNA, 20 bp, Artificial Sequence
  Description of Artificial Sequence: Synthetic oligonucleotide
tgattcctctggttcgtccc

SEQ ID NO: 7059 - DNA, 20 bp, Artificial Sequence
  Description of Artificial Sequence: Synthetic oligonucleotide
gcctttcggtctaccctccc

SEQ ID NO: 7060 - DNA, 21 bp, Artificial Sequence
  Description of Artificial Sequence: Synthetic oligonucleotide
gcctttcgttctgcacctccc

SEQ ID NO: 7061 - DNA, 20 bp, Artificial Sequence
  Description of Artificial Sequence: Synthetic oligonucleotide
tttggagggtgctgggtccg

SEQ ID NO: 7062 - DNA, 20 bp, Artificial Sequence
  Description of Artificial Sequence: Synthetic oligonucleotide
cttcattcctttcactaccg

SEQ ID NO: 7063 - DNA, 19 bp, Artificial Sequence
  Description of Artificial Sequence: Synthetic oligonucleotide
tctttttctaccctttccg

SEQ ID NO: 7064 - DNA, 20 bp, Artificial Sequence
  Description of Artificial Sequence: Synthetic oligonucleotide
taaggaggagttggggaccg

SEQ ID NO: 7065 - DNA, 20 bp, Artificial Sequence
  Description of Artificial Sequence: Synthetic oligonucleotide
tcccttttaccttttccccg

SEQ ID NO: 7066 - DNA, 21 bp, Artificial Sequence
  Description of Artificial Sequence: Synthetic oligonucleotide
tttttttcacttttccctctg

SEQ ID NO: 7067 - DNA, 20 bp, Artificial Sequence
  Description of Artificial Sequence: Synthetic oligonucleotide
tactttcacttgcctttccg

SEQ ID NO: 7068 - DNA, 20 bp, Artificial Sequence
  Description of Artificial Sequence: Synthetic oligonucleotide
tgttttatagttctgttccg

SEQ ID NO: 7069 - DNA, 20 bp, Artificial Sequence
  Description of Artificial Sequence: Synthetic oligonucleotide
acttttttattttttacctg

SEQ ID NO: 7070 - DNA, 20 bp, Artificial Sequence
  Description of Artificial Sequence: Synthetic oligonucleotide
ttcttgttttctctatcccc

SEQ ID NO: 7071 - DNA, 20 bp, Artificial Sequence
  Description of Artificial Sequence: Synthetic oligonucleotide
actttcctttgtttccaccg

SEQ ID NO: 7072 - DNA, 20 bp, Artificial Sequence
  Description of Artificial Sequence: Synthetic oligonucleotide
cattgttcgttttttctcgc

SEQ ID NO: 7073 - DNA, 19 bp, Artificial Sequence
  Description of Artificial Sequence: Synthetic oligonucleotide
tttctcttttctctttccg

SEQ ID NO: 7074 - DNA, 20 bp, Artificial Sequence
  Description of Artificial Sequence: Synthetic oligonucleotide
ctcattcttatttatttccg

SEQ ID NO: 7075 - DNA, 22 bp, Artificial Sequence
  Description of Artificial Sequence: Synthetic oligonucleotide
tattttgtcacttttttttccg

SEQ ID NO: 7076 - DNA, 20 bp, Artificial Sequence
  Description of Artificial Sequence: Synthetic oligonucleotide
tttgtttttctttttttccg

SEQ ID NO: 7077 - DNA, 20 bp, Artificial Sequence
  Description of Artificial Sequence: Synthetic oligonucleotide
cttcttttactttctttccg

SEQ ID NO: 7078 - DNA, 20 bp, Artificial Sequence
  Description of Artificial Sequence: Synthetic oligonucleotide
tgtcgtagtttatccgcccg

SEQ ID NO: 7079 - DNA, 20 bp, Artificial Sequence
  Description of Artificial Sequence: Synthetic oligonucleotide
cgactcgatctgctcgtccc

SEQ ID NO: 7080 - DNA, 20 bp, Artificial Sequence
  Description of Artificial Sequence: Synthetic oligonucleotide
gcttttcgttctgccttccc

SEQ ID NO: 7081 - DNA, 20 bp, Artificial Sequence
  Description of Artificial Sequence: Synthetic oligonucleotide
ttctttactaactcttgccg

SEQ ID NO: 7082 - DNA, 21 bp, Artificial Sequence
  Description of Artificial Sequence: Synthetic oligonucleotide
atttgcttttttttgattccg

SEQ ID NO: 7083 - DNA, 20 bp, Artificial Sequence
  Description of Artificial Sequence: Synthetic oligonucleotide
ttctttactttttccctccg

SEQ ID NO: 7084 - DNA, 20 bp, Artificial Sequence
  Description of Artificial Sequence: Synthetic oligonucleotide
atctttattttctctctccg

SEQ ID NO: 7085 - DNA, 20 bp, Artificial Sequence
  Description of Artificial Sequence: Synthetic oligonucleotide
tttgacgggtgatggggccg

SEQ ID NO: 7086 - DNA, 20 bp, Artificial Sequence
  Description of Artificial Sequence: Synthetic oligonucleotide
ttttcttgcctttttttccg

SEQ ID NO: 7087 - DNA, 19 bp, Artificial Sequence
  Description of Artificial Sequence: Synthetic oligonucleotide
ttattttccttttttgccg

SEQ ID NO: 7088 - DNA, 20 bp, Artificial Sequence
  Description of Artificial Sequence: Synthetic oligonucleotide
attttctcttttttccgccg

SEQ ID NO: 7089 - DNA, 20 bp, Artificial Sequence
  Description of Artificial Sequence: Synthetic oligonucleotide
tttggagggtgttgggtccg

SEQ ID NO: 7090 - DNA, 21 bp, Artificial Sequence
  Description of Artificial Sequence: Synthetic oligonucleotide
attcctacttttttttccccg

SEQ ID NO: 7091 - DNA, 20 bp, Artificial Sequence
  Description of Artificial Sequence: Synthetic oligonucleotide
aactttatttacttttcccc

SEQ ID NO: 7092 - DNA, 20 bp, Artificial Sequence
  Description of Artificial Sequence: Synthetic oligonucleotide
tgtcacttttttcctttccg

SEQ ID NO: 7093 - DNA, 20 bp, Artificial Sequence
  Description of Artificial Sequence: Synthetic oligonucleotide
tttcttattctttctttctg

SEQ ID NO: 7094 - DNA, 19 bp, Artificial Sequence
  Description of Artificial Sequence: Synthetic oligonucleotide
tcttttgtttctttatccg

SEQ ID NO: 7095 - DNA, 22 bp, Artificial Sequence
  Description of Artificial Sequence: Synthetic oligonucleotide
tctttttttttcactttctccg

SEQ ID NO: 7096 - DNA, 20 bp, Artificial Sequence
  Description of Artificial Sequence: Synthetic oligonucleotide
actttttgttatttatcccg

SEQ ID NO: 7097 - DNA, 19 bp, Artificial Sequence
  Description of Artificial Sequence: Synthetic oligonucleotide
tttatcttttttttgtgtg

SEQ ID NO: 7098 - DNA, 20 bp, Artificial Sequence
  Description of Artificial Sequence: Synthetic oligonucleotide
gcttctttcttatttcaccg

SEQ ID NO: 7099 - DNA, 20 bp, Artificial Sequence
  Description of Artificial Sequence: Synthetic oligonucleotide
agattattttttttgttgtg

SEQ ID NO: 7100 - DNA, 20 bp, Artificial Sequence
  Description of Artificial Sequence: Synthetic oligonucleotide
tctctgttaatttatccccg

SEQ ID NO: 7101 - DNA, 19 bp, Artificial Sequence
  Description of Artificial Sequence: Synthetic oligonucleotide
ctttattcacttttttccg

SEQ ID NO: 7102 - DNA, 20 bp, Artificial Sequence
  Description of Artificial Sequence: Synthetic oligonucleotide
ttttatttttttgtcgggcc

SEQ ID NO: 7103 - DNA, 20 bp, Artificial Sequence
  Description of Artificial Sequence: Synthetic oligonucleotide
tctatattgatctctctccg

SEQ ID NO: 7104 - DNA, 21 bp, Artificial Sequence
  Description of Artificial Sequence: Synthetic oligonucleotide
gtttgtcttttttttcgtccg

SEQ ID NO: 7105 - DNA, 20 bp, Artificial Sequence
  Description of Artificial Sequence: Synthetic oligonucleotide
ccttttactctttttctccg

SEQ ID NO: 7106 - DNA, 21 bp, Artificial Sequence
  Description of Artificial Sequence: Synthetic oligonucleotide
ctttcactttttctctctccg

SEQ ID NO: 7107 - DNA, 21 bp, Artificial Sequence
  Description of Artificial Sequence: Synthetic oligonucleotide
tctttttaacttttttctccg

SEQ ID NO: 7108 - DNA, 20 bp, Artificial Sequence
  Description of Artificial Sequence: Synthetic oligonucleotide
tttttgtctttttttacccg

SEQ ID NO: 7109 - DNA, 21 bp, Artificial Sequence
  Description of Artificial Sequence: Synthetic oligonucleotide
gctattcttttctttttcccc

SEQ ID NO: 7110 - DNA, 20 bp, Artificial Sequence
  Description of Artificial Sequence: Synthetic oligonucleotide
tttgaaggtttatgggtccg

SEQ ID NO: 7111 - DNA, 21 bp, Artificial Sequence
  Description of Artificial Sequence: Synthetic oligonucleotide
cctttactttaatcattcccg

SEQ ID NO: 7112 - DNA, 20 bp, Artificial Sequence
  Description of Artificial Sequence: Synthetic oligonucleotide
cttcattttatctctttccg

SEQ ID NO: 7113 - DNA, 20 bp, Artificial Sequence
  Description of Artificial Sequence: Synthetic oligonucleotide
ctttcacttttttttctccg

SEQ ID NO: 7114 - DNA, 20 bp, Artificial Sequence
  Description of Artificial Sequence: Synthetic oligonucleotide
tttttcatttcctttttccg

SEQ ID NO: 7115 - DNA, 22 bp, Artificial Sequence
  Description of Artificial Sequence: Synthetic oligonucleotide
ccatttgtttttttttcctccg

SEQ ID NO: 7116 - DNA, 20 bp, Artificial Sequence
  Description of Artificial Sequence: Synthetic oligonucleotide
cttgtttttctctttttccg

SEQ ID NO: 7117 - DNA, 21 bp, Artificial Sequence
  Description of Artificial Sequence: Synthetic oligonucleotide
gttctgtcgtctgttcgtccc

SEQ ID NO: 7118 - DNA, 18 bp, Artificial Sequence
  Description of Artificial Sequence: Synthetic oligonucleotide
attcttgtttttttgccg

SEQ ID NO: 7119 - DNA, 20 bp, Artificial Sequence
  Description of Artificial Sequence: Synthetic oligonucleotide
tccttccgttctgccctccc

SEQ ID NO: 7120 - DNA, 20 bp, Artificial Sequence
  Description of Artificial Sequence: Synthetic oligonucleotide
attcactccttttcttgccg

SEQ ID NO: 7121 - DNA, 20 bp, Artificial Sequence
  Description of Artificial Sequence: Synthetic oligonucleotide
tactcttatttttacctccg

SEQ ID NO: 7122 - DNA, 19 bp, Artificial Sequence
  Description of Artificial Sequence: Synthetic oligonucleotide
gctttcgttctaccctccc

SEQ ID NO: 7123 - DNA, 19 bp, Artificial Sequence
  Description of Artificial Sequence: Synthetic oligonucleotide
ttcattttcttttcttccg

SEQ ID NO: 7124 - DNA, 20 bp, Artificial Sequence
  Description of Artificial Sequence: Synthetic oligonucleotide
tcctgtcgactgctcgtccc

SEQ ID NO: 7125 - DNA, 21 bp, Artificial Sequence
  Description of Artificial Sequence: Synthetic oligonucleotide
gtcctgtcgtctcttcgtccc

SEQ ID NO: 7126 - DNA, 21 bp, Artificial Sequence
  Description of Artificial Sequence: Synthetic oligonucleotide
gtcctgtcgtctgtacgtccc

SEQ ID NO: 7127 - DNA, 18 bp, Artificial Sequence
  Description of Artificial Sequence: Synthetic oligonucleotide
gccttcgttctccctccc

SEQ ID NO: 7128 - DNA, 20 bp, Artificial Sequence
  Description of Artificial Sequence: Synthetic oligonucleotide
tccttatgttttacgtcccc

SEQ ID NO: 7129 - DNA, 20 bp, Artificial Sequence
  Description of Artificial Sequence: Synthetic oligonucleotide
tacgcggtataagtgtgccc

SEQ ID NO: 7130 - DNA, 20 bp, Artificial Sequence
  Description of Artificial Sequence: Synthetic oligonucleotide
ttccttttgctttctctccg

SEQ ID NO: 7131 - DNA, 19 bp, Artificial Sequence
  Description of Artificial Sequence: Synthetic oligonucleotide
tgactcgtctgtttgtccc

SEQ ID NO: 7132 - DNA, 20 bp, Artificial Sequence
  Description of Artificial Sequence: Synthetic oligonucleotide
attcttgcctttttttgccg

SEQ ID NO: 7133 - DNA, 20 bp, Artificial Sequence
  Description of Artificial Sequence: Synthetic oligonucleotide
ttttaagggtgttgggtccg

SEQ ID NO: 7134 - DNA, 20 bp, Artificial Sequence
  Description of Artificial Sequence: Synthetic oligonucleotide
gtttttgtctttctcatccc

SEQ ID NO: 7135 - DNA, 20 bp, Artificial Sequence
  Description of Artificial Sequence: Synthetic oligonucleotide
ttcatcattcattttctgcc

SEQ ID NO: 7136 - DNA, 19 bp, Artificial Sequence
  Description of Artificial Sequence: Synthetic oligonucleotide
tcctttcgttctgccctcc

SEQ ID NO: 7137 - DNA, 20 bp, Artificial Sequence
  Description of Artificial Sequence: Synthetic oligonucleotide
tttcctgcttctattatccg

SEQ ID NO: 7138 - DNA, 21 bp, Artificial Sequence
  Description of Artificial Sequence: Synthetic oligonucleotide
atttggtctcttttttcgccg

SEQ ID NO: 7139 - DNA, 20 bp, Artificial Sequence
  Description of Artificial Sequence: Synthetic oligonucleotide
tgtttccttttccttcgccc

SEQ ID NO: 7140 - DNA, 19 bp, Artificial Sequence
  Description of Artificial Sequence: Synthetic oligonucleotide
atttctctcttctttgccg

SEQ ID NO: 7141 - DNA, 20 bp, Artificial Sequence
  Description of Artificial Sequence: Synthetic oligonucleotide
cataggggtagggtggtagc

SEQ ID NO: 7142 - DNA, 20 bp, Artificial Sequence
  Description of Artificial Sequence: Synthetic oligonucleotide
tccttgtcgtcttgcgaccc

SEQ ID NO: 7143 - DNA, 20 bp, Artificial Sequence
  Description of Artificial Sequence: Synthetic oligonucleotide
gcttttcgttctgccccccc

SEQ ID NO: 7144 - DNA, 20 bp, Artificial Sequence
  Description of Artificial Sequence: Synthetic oligonucleotide
tcacagcggaattgtggccc

SEQ ID NO: 7145 - DNA, 20 bp, Artificial Sequence
  Description of Artificial Sequence: Synthetic oligonucleotide
attactcttttcttttgccg

SEQ ID NO: 7146 - DNA, 20 bp, Artificial Sequence
  Description of Artificial Sequence: Synthetic oligonucleotide
ctcgcttttcatcttctccg

SEQ ID NO: 7147 - DNA, 19 bp, Artificial Sequence
  Description of Artificial Sequence: Synthetic oligonucleotide
tctcatcttcttttctccg

SEQ ID NO: 7148 - DNA, 20 bp, Artificial Sequence
  Description of Artificial Sequence: Synthetic oligonucleotide
tcttttcatgcttctctccg

SEQ ID NO: 7149 - DNA, 20 bp, Artificial Sequence
  Description of Artificial Sequence: Synthetic oligonucleotide
tcctgtcgcctgctcgtccc

SEQ ID NO: 7150 - DNA, 20 bp, Artificial Sequence
  Description of Artificial Sequence: Synthetic oligonucleotide
attcttttctcttttctccg

SEQ ID NO: 7151 - DNA, 20 bp, Artificial Sequence
  Description of Artificial Sequence: Synthetic oligonucleotide
acattattttcttctctgcc

SEQ ID NO: 7152 - DNA, 20 bp, Artificial Sequence
  Description of Artificial Sequence: Synthetic oligonucleotide
cctattccttactctctccg

SEQ ID NO: 7153 - DNA, 20 bp, Artificial Sequence
  Description of Artificial Sequence: Synthetic oligonucleotide
atactttcactctcttcccg

SEQ ID NO: 7154 - DNA, 20 bp, Artificial Sequence
  Description of Artificial Sequence: Synthetic oligonucleotide
gcctttcgttctatcctccc

SEQ ID NO: 7155 - DNA, 20 bp, Artificial Sequence
  Description of Artificial Sequence: Synthetic oligonucleotide
cctattttctcttctttgcc

SEQ ID NO: 7156 - DNA, 22 bp, Artificial Sequence
  Description of Artificial Sequence: Synthetic oligonucleotide
ttttagactcttttttttgccc

SEQ ID NO: 7157 - DNA, 20 bp, Artificial Sequence
  Description of Artificial Sequence: Synthetic oligonucleotide
ttttcctattttgccgtccg

SEQ ID NO: 7158 - DNA, 20 bp, Artificial Sequence
  Description of Artificial Sequence: Synthetic oligonucleotide
tcactttttcttccacaccc

SEQ ID NO: 7159 - DNA, 20 bp, Artificial Sequence
  Description of Artificial Sequence: Synthetic oligonucleotide
attttcatttctacccactg

SEQ ID NO: 7160 - DNA, 20 bp, Artificial Sequence
  Description of Artificial Sequence: Synthetic oligonucleotide
cttttcttcctcttttgccc

SEQ ID NO: 7161 - DNA, 18 bp, Artificial Sequence
  Description of Artificial Sequence: Synthetic oligonucleotide
ttttgttttttttctgcc

SEQ ID NO: 7162 - DNA, 20 bp, Artificial Sequence
  Description of Artificial Sequence: Synthetic oligonucleotide
tgtcttttatttctccgccc

SEQ ID NO: 7163 - DNA, 20 bp, Artificial Sequence
  Description of Artificial Sequence: Synthetic oligonucleotide
ctatttactttttgtccccg

SEQ ID NO: 7164 - DNA, 21 bp, Artificial Sequence
  Description of Artificial Sequence: Synthetic oligonucleotide
ctttatttttcaacccctccg

SEQ ID NO: 7165 - DNA, 18 bp, Artificial Sequence
  Description of Artificial Sequence: Synthetic oligonucleotide
atttttgtattcttgccc

SEQ ID NO: 7166 - DNA, 19 bp, Artificial Sequence
  Description of Artificial Sequence: Synthetic oligonucleotide
tctttatatttcctttccg

SEQ ID NO: 7167 - DNA, 20 bp, Artificial Sequence
  Description of Artificial Sequence: Synthetic oligonucleotide
ttctacttatcctttgtccg

SEQ ID NO: 7168 - DNA, 20 bp, Artificial Sequence
  Description of Artificial Sequence: Synthetic oligonucleotide
ttctcttatttacttctccg

SEQ ID NO: 7169 - DNA, 20 bp, Artificial Sequence
  Description of Artificial Sequence: Synthetic oligonucleotide
catcttaattctttcctctg

SEQ ID NO: 7170 - DNA, 20 bp, Artificial Sequence
  Description of Artificial Sequence: Synthetic oligonucleotide
tttggagtgtgatgggtccg

SEQ ID NO: 7171 - DNA, 20 bp, Artificial Sequence
  Description of Artificial Sequence: Synthetic oligonucleotide
aattatgttttttgtgaccg

SEQ ID NO: 7172 - DNA, 19 bp, Artificial Sequence
  Description of Artificial Sequence: Synthetic oligonucleotide
tccttgtcgtctgcgtccc

SEQ ID NO: 7173 - DNA, 20 bp, Artificial Sequence
  Description of Artificial Sequence: Synthetic oligonucleotide
tttggggctttcccgtgccg

SEQ ID NO: 7174 - DNA, 19 bp, Artificial Sequence
  Description of Artificial Sequence: Synthetic oligonucleotide
gtcttcgttctgccctccc

SEQ ID NO: 7175 - DNA, 20 bp, Artificial Sequence
  Description of Artificial Sequence: Synthetic oligonucleotide
aacacattacactgtgtgcc

SEQ ID NO: 7176 - DNA, 20 bp, Artificial Sequence
  Description of Artificial Sequence: Synthetic oligonucleotide
ttttattcttttcctctccg

SEQ ID NO: 7177 - DNA, 20 bp, Artificial Sequence
  Description of Artificial Sequence: Synthetic oligonucleotide
tattctaccttgcttctccg

SEQ ID NO: 7178 - DNA, 20 bp, Artificial Sequence
  Description of Artificial Sequence: Synthetic oligonucleotide
ttcatttcttctcttttccg

SEQ ID NO: 7179 - DNA, 22 bp, Artificial Sequence
  Description of Artificial Sequence: Synthetic oligonucleotide
tattttacgttttttttcgctg

SEQ ID NO: 7180 - DNA, 20 bp, Artificial Sequence
  Description of Artificial Sequence: Synthetic oligonucleotide
ctcactttttctttaccccc

SEQ ID NO: 7181 - DNA, 20 bp, Artificial Sequence
  Description of Artificial Sequence: Synthetic oligonucleotide
tttgaagggtgttggttccg

SEQ ID NO: 7182 - DNA, 20 bp, Artificial Sequence
  Description of Artificial Sequence: Synthetic oligonucleotide
ttcgaagggtgacgggtccg

SEQ ID NO: 7183 - DNA, 20 bp, Artificial Sequence
  Description of Artificial Sequence: Synthetic oligonucleotide
ttagggagtagggtgttccg

SEQ ID NO: 7184 - DNA, 20 bp, Artificial Sequence
  Description of Artificial Sequence: Synthetic oligonucleotide
tttttgttttattggttccg

SEQ ID NO: 7185 - DNA, 20 bp, Artificial Sequence
  Description of Artificial Sequence: Synthetic oligonucleotide
gcctttcgttctaccctccg

SEQ ID NO: 7186 - DNA, 20 bp, Artificial Sequence
  Description of Artificial Sequence: Synthetic oligonucleotide
attcttttctctttccaccg

SEQ ID NO: 7187 - DNA, 20 bp, Artificial Sequence
  Description of Artificial Sequence: Synthetic oligonucleotide
tttgaagggtgttaggtccg

SEQ ID NO: 7188 - DNA, 20 bp, Artificial Sequence
  Description of Artificial Sequence: Synthetic oligonucleotide
ttgggtgcagggcggtaccg

SEQ ID NO: 7189 - DNA, 20 bp, Artificial Sequence
  Description of Artificial Sequence: Synthetic oligonucleotide
tttgaggggaggtgggtccg

SEQ ID NO: 7190 - DNA, 20 bp, Artificial Sequence
  Description of Artificial Sequence: Synthetic oligonucleotide
gatatttactttttttggcc

SEQ ID NO: 7191 - DNA, 20 bp, Artificial Sequence
  Description of Artificial Sequence: Synthetic oligonucleotide
tttgacgggtgttgggtccg

SEQ ID NO: 7192 - DNA, 20 bp, Artificial Sequence
  Description of Artificial Sequence: Synthetic oligonucleotide
tctgtttttctctttttccg

SEQ ID NO: 7193 - DNA, 21 bp, Artificial Sequence
  Description of Artificial Sequence: Synthetic oligonucleotide
acatttcatttttttcccccg

SEQ ID NO: 7194 - DNA, 19 bp, Artificial Sequence
  Description of Artificial Sequence: Synthetic oligonucleotide
ttcttattttttccctccg

SEQ ID NO: 7195 - DNA, 19 bp, Artificial Sequence
  Description of Artificial Sequence: Synthetic oligonucleotide
cctttttatgttctttccg

SEQ ID NO: 7196 - DNA, 20 bp, Artificial Sequence
  Description of Artificial Sequence: Synthetic oligonucleotide
cttcttgtgtttttttgctg

SEQ ID NO: 7197 - DNA, 19 bp, Artificial Sequence
  Description of Artificial Sequence: Synthetic oligonucleotide
ttcttcttcttttcctccg

SEQ ID NO: 7198 - DNA, 20 bp, Artificial Sequence
  Description of Artificial Sequence: Synthetic oligonucleotide
tttgaagtgttatgggtccg

SEQ ID NO: 7199 - DNA, 20 bp, Artificial Sequence
  Description of Artificial Sequence: Synthetic oligonucleotide
gttcttaatcaccttttccc

SEQ ID NO: 7200 - DNA, 20 bp, Artificial Sequence
  Description of Artificial Sequence: Synthetic oligonucleotide
tgtattattatttgttgctg

SEQ ID NO: 7201 - DNA, 20 bp, Artificial Sequence
  Description of Artificial Sequence: Synthetic oligonucleotide
ctttatttttgttttttgcc

SEQ ID NO: 7202 - DNA, 20 bp, Artificial Sequence
  Description of Artificial Sequence: Synthetic oligonucleotide
ccatatttcttctttatccc

SEQ ID NO: 7203 - DNA, 19 bp, Artificial Sequence
  Description of Artificial Sequence: Synthetic oligonucleotide
ttttttctccggttttccg

SEQ ID NO: 7204 - DNA, 20 bp, Artificial Sequence
  Description of Artificial Sequence: Synthetic oligonucleotide
tattcttcattatttgtcac

SEQ ID NO: 7205 - DNA, 20 bp, Artificial Sequence
  Description of Artificial Sequence: Synthetic oligonucleotide
cctttttttgtcctttgccc

SEQ ID NO: 7206 - DNA, 20 bp, Artificial Sequence
  Description of Artificial Sequence: Synthetic oligonucleotide
ctcatttattacttttaccg

SEQ ID NO: 7207 - DNA, 20 bp, Artificial Sequence
  Description of Artificial Sequence: Synthetic oligonucleotide
attttatctatccgtttccg

SEQ ID NO: 7208 - DNA, 20 bp, Artificial Sequence
  Description of Artificial Sequence: Synthetic oligonucleotide
ctttcacgtcatcttttccg

SEQ ID NO: 7209 - DNA, 20 bp, Artificial Sequence
  Description of Artificial Sequence: Synthetic oligonucleotide
gctttacgttctttattccg

SEQ ID NO: 7210 - DNA, 20 bp, Artificial Sequence
  Description of Artificial Sequence: Synthetic oligonucleotide
tcacatttactttttttgcg

SEQ ID NO: 7211 - DNA, 20 bp, Artificial Sequence
  Description of Artificial Sequence: Synthetic oligonucleotide
cttgttgttttttttatccc

SEQ ID NO: 7212 - DNA, 20 bp, Artificial Sequence
  Description of Artificial Sequence: Synthetic oligonucleotide
ttcctttttactttcttgtg

SEQ ID NO: 7213 - DNA, 20 bp, Artificial Sequence
  Description of Artificial Sequence: Synthetic oligonucleotide
ttttctcttctctacttctg

SEQ ID NO: 7214 - DNA, 20 bp, Artificial Sequence
  Description of Artificial Sequence: Synthetic oligonucleotide
cttcacttattccttatccc

SEQ ID NO: 7215 - DNA, 20 bp, Artificial Sequence
  Description of Artificial Sequence: Synthetic oligonucleotide
atttttacatttgctctccg

SEQ ID NO: 7216 - DNA, 20 bp, Artificial Sequence
  Description of Artificial Sequence: Synthetic oligonucleotide
ttatctatattctctctgtg

SEQ ID NO: 7217 - DNA, 20 bp, Artificial Sequence
  Description of Artificial Sequence: Synthetic oligonucleotide
tcttttcatttttctctccg

SEQ ID NO: 7218 - DNA, 21 bp, Artificial Sequence
  Description of Artificial Sequence: Synthetic oligonucleotide
tttttttacttctcttcgctg

SEQ ID NO: 7219 - DNA, 21 bp, Artificial Sequence
  Description of Artificial Sequence: Synthetic oligonucleotide
cttttactgtttccttttccg

SEQ ID NO: 7220 - DNA, 20 bp, Artificial Sequence
  Description of Artificial Sequence: Synthetic oligonucleotide
atttgttctttaatttgccg

SEQ ID NO: 7221 - DNA, 20 bp, Artificial Sequence
  Description of Artificial Sequence: Synthetic oligonucleotide
ttctttattttctccctccg

SEQ ID NO: 7222 - DNA, 20 bp, Artificial Sequence
  Description of Artificial Sequence: Synthetic oligonucleotide
ctttccaggctttttctccg

SEQ ID NO: 7223 - DNA, 20 bp, Artificial Sequence
  Description of Artificial Sequence: Synthetic oligonucleotide
tcagttattatttttttcgc

SEQ ID NO: 7224 - DNA, 20 bp, Artificial Sequence
  Description of Artificial Sequence: Synthetic oligonucleotide
tatgaaggtgaggtggtccg

SEQ ID NO: 7225 - DNA, 20 bp, Artificial Sequence
  Description of Artificial Sequence: Synthetic oligonucleotide
cttaatctttcttccttccg

SEQ ID NO: 7226 - DNA, 20 bp, Artificial Sequence
  Description of Artificial Sequence: Synthetic oligonucleotide
actcttatcttatcttgccg

SEQ ID NO: 7227 - DNA, 20 bp, Artificial Sequence
  Description of Artificial Sequence: Synthetic oligonucleotide
ttttctttttcacttttccg

SEQ ID NO: 7228 - DNA, 20 bp, Artificial Sequence
  Description of Artificial Sequence: Synthetic oligonucleotide
tcattatctttcttctccac

SEQ ID NO: 7229 - DNA, 20 bp, Artificial Sequence
  Description of Artificial Sequence: Synthetic oligonucleotide
aattattttttgcctctccg

SEQ ID NO: 7230 - DNA, 20 bp, Artificial Sequence
  Description of Artificial Sequence: Synthetic oligonucleotide
ctctttttggttactctccg

SEQ ID NO: 7231 - DNA, 20 bp, Artificial Sequence
  Description of Artificial Sequence: Synthetic oligonucleotide
tttactcttacctttgcccg

SEQ ID NO: 7232 - DNA, 20 bp, Artificial Sequence
  Description of Artificial Sequence: Synthetic oligonucleotide
gtccttttactttttccccg

SEQ ID NO: 7233 - DNA, 19 bp, Artificial Sequence
  Description of Artificial Sequence: Synthetic oligonucleotide
gcttcttttctcttttccc

SEQ ID NO: 7234 - DNA, 20 bp, Artificial Sequence
  Description of Artificial Sequence: Synthetic oligonucleotide
gtatctttttcctcgctccg

SEQ ID NO: 7235 - DNA, 21 bp, Artificial Sequence
  Description of Artificial Sequence: Synthetic oligonucleotide
acctattcttttaccctaccg

SEQ ID NO: 7236 - DNA, 21 bp, Artificial Sequence
  Description of Artificial Sequence: Synthetic oligonucleotide
tatttattttttttctctctg

SEQ ID NO: 7237 - DNA, 20 bp, Artificial Sequence
  Description of Artificial Sequence: Synthetic oligonucleotide
tccctttgttcttttcaccg

SEQ ID NO: 7238 - DNA, 20 bp, Artificial Sequence
  Description of Artificial Sequence: Synthetic oligonucleotide
tgttttattttatctgttcc

SEQ ID NO: 7239 - DNA, 20 bp, Artificial Sequence
  Description of Artificial Sequence: Synthetic oligonucleotide
ctttttcacttctatttccc

SEQ ID NO: 7240 - DNA, 20 bp, Artificial Sequence
  Description of Artificial Sequence: Synthetic oligonucleotide
cacttttgctcttttctcgc

SEQ ID NO: 7241 - DNA, 20 bp, Artificial Sequence
  Description of Artificial Sequence: Synthetic oligonucleotide
ccacttttaattttctccgc

SEQ ID NO: 7242 - DNA, 20 bp, Artificial Sequence
  Description of Artificial Sequence: Synthetic oligonucleotide
tttcactatcttaccttccg

SEQ ID NO: 7243 - DNA, 20 bp, Artificial Sequence
  Description of Artificial Sequence: Synthetic oligonucleotide
tttgaatggtgttgggtccg

SEQ ID NO: 7244 - DNA, 21 bp, Artificial Sequence
  Description of Artificial Sequence: Synthetic oligonucleotide
tttctactttttcattgtccg

SEQ ID NO: 7245 - DNA, 20 bp, Artificial Sequence
  Description of Artificial Sequence: Synthetic oligonucleotide
tttgatggttgatgggtccg

SEQ ID NO: 7246 - DNA, 20 bp, Artificial Sequence
  Description of Artificial Sequence: Synthetic oligonucleotide
tttatcacttttctttgcac

SEQ ID NO: 7247 - DNA, 20 bp, Artificial Sequence
  Description of Artificial Sequence: Synthetic oligonucleotide
actttgtcatccttttgccg

SEQ ID NO: 7248 - DNA, 20 bp, Artificial Sequence
  Description of Artificial Sequence: Synthetic oligonucleotide
ccttcactttttcttttccg

SEQ ID NO: 7249 - DNA, 20 bp, Artificial Sequence
  Description of Artificial Sequence: Synthetic oligonucleotide
ctttcattcacattcctccg

SEQ ID NO: 7250 - DNA, 20 bp, Artificial Sequence
  Description of Artificial Sequence: Synthetic oligonucleotide
ctttttcagtcttgcttccg

SEQ ID NO: 7251 - DNA, 20 bp, Artificial Sequence
  Description of Artificial Sequence: Synthetic oligonucleotide
gatttgtttatgtttacctg

SEQ ID NO: 7252 - DNA, 20 bp, Artificial Sequence
  Description of Artificial Sequence: Synthetic oligonucleotide
tttccgttctattttctgcc

SEQ ID NO: 7253 - DNA, 20 bp, Artificial Sequence
  Description of Artificial Sequence: Synthetic oligonucleotide
cttttttttccttttttccg

SEQ ID NO: 7254 - DNA, 20 bp, Artificial Sequence
  Description of Artificial Sequence: Synthetic oligonucleotide
ttatttatttcttttgtgtg

SEQ ID NO: 7255 - DNA, 20 bp, Artificial Sequence
  Description of Artificial Sequence: Synthetic oligonucleotide
cattcgtttactttttcccg

SEQ ID NO: 7256 - DNA, 20 bp, Artificial Sequence
  Description of Artificial Sequence: Synthetic oligonucleotide
aaaggaggagctgggatctg

SEQ ID NO: 7257 - DNA, 20 bp, Artificial Sequence
  Description of Artificial Sequence: Synthetic oligonucleotide
gttggggtaggggggttccg

SEQ ID NO: 7258 - DNA, 20 bp, Artificial Sequence
  Description of Artificial Sequence: Synthetic oligonucleotide
cttttcacggcttttttccg

SEQ ID NO: 7259 - DNA, 22 bp, Artificial Sequence
  Description of Artificial Sequence: Synthetic oligonucleotide
tacttttctttttttttctccg

SEQ ID NO: 7260 - DNA, 20 bp, Artificial Sequence
  Description of Artificial Sequence: Synthetic oligonucleotide
tcacattcattttatctctc

SEQ ID NO: 7261 - DNA, 20 bp, Artificial Sequence
  Description of Artificial Sequence: Synthetic oligonucleotide
gtcttaaaactttctctccg

SEQ ID NO: 7262 - DNA, 20 bp, Artificial Sequence
  Description of Artificial Sequence: Synthetic oligonucleotide
tttccattttccctcatccg

SEQ ID NO: 7263 - DNA, 20 bp, Artificial Sequence
  Description of Artificial Sequence: Synthetic oligonucleotide
tttctcattcaattttgccc

SEQ ID NO: 7264 - DNA, 20 bp, Artificial Sequence
  Description of Artificial Sequence: Synthetic oligonucleotide
gtcacattattttacttccc

SEQ ID NO: 7265 - DNA, 19 bp, Artificial Sequence
  Description of Artificial Sequence: Synthetic oligonucleotide
gccctcgttctgccctccc

SEQ ID NO: 7266 - DNA, 18 bp, Artificial Sequence
  Description of Artificial Sequence: Synthetic oligonucleotide
ccttcgttctgccctccc

SEQ ID NO: 7267 - DNA, 18 bp, Artificial Sequence
  Description of Artificial Sequence: Synthetic oligonucleotide
gcctttcgttctccctcc

SEQ ID NO: 7268 - DNA, 20 bp, Artificial Sequence
  Description of Artificial Sequence: Synthetic oligonucleotide
gcctttcgttctgcttcccc

SEQ ID NO: 7269 - DNA, 21 bp, Artificial Sequence
  Description of Artificial Sequence: Synthetic oligonucleotide
gccatttcgttctgccctccc

SEQ ID NO: 7270 - DNA, 20 bp, Artificial Sequence
  Description of Artificial Sequence: Synthetic oligonucleotide
tcctttcggtctgccctccc

SEQ ID NO: 7271 - DNA, 19 bp, Artificial Sequence
  Description of Artificial Sequence: Synthetic oligonucleotide
gccttcgttctgcctcccc

SEQ ID NO: 7272 - DNA, 20 bp, Artificial Sequence
  Description of Artificial Sequence: Synthetic oligonucleotide
actatctctttattccaccg

SEQ ID NO: 7273 - DNA, 20 bp, Artificial Sequence
  Description of Artificial Sequence: Synthetic oligonucleotide
tatcttattcttcgctttgc

SEQ ID NO: 7274 - DNA, 20 bp, Artificial Sequence
  Description of Artificial Sequence: Synthetic oligonucleotide
ccgtttttcctttttatccg

SEQ ID NO: 7275 - DNA, 20 bp, Artificial Sequence
  Description of Artificial Sequence: Synthetic oligonucleotide
catttcttattactcttcgc

SEQ ID NO: 7276 - DNA, 20 bp, Artificial Sequence
  Description of Artificial Sequence: Synthetic oligonucleotide
attttccttttttttcccgc

SEQ ID NO: 7277 - DNA, 20 bp, Artificial Sequence
  Description of Artificial Sequence: Synthetic oligonucleotide
ccttttaacatgtttctccg

SEQ ID NO: 7278 - DNA, 21 bp, Artificial Sequence
  Description of Artificial Sequence: Synthetic oligonucleotide
tttttttctttgccctttccg

SEQ ID NO: 7279 - DNA, 21 bp, Artificial Sequence
  Description of Artificial Sequence: Synthetic oligonucleotide
tttttttctaatttctccccg

SEQ ID NO: 7280 - DNA, 20 bp, Artificial Sequence
  Description of Artificial Sequence: Synthetic oligonucleotide
gtcattcatttttctcgccg

SEQ ID NO: 7281 - DNA, 20 bp, Artificial Sequence
  Description of Artificial Sequence: Synthetic oligonucleotide
tcactattcttttctttctg

SEQ ID NO: 7282 - DNA, 18 bp, Artificial Sequence
  Description of Artificial Sequence: Synthetic oligonucleotide
atttctcttcttttgccg

SEQ ID NO: 7283 - DNA, 20 bp, Artificial Sequence
  Description of Artificial Sequence: Synthetic oligonucleotide
tcacttcttaatttattccc

SEQ ID NO: 7284 - DNA, 21 bp, Artificial Sequence
  Description of Artificial Sequence: Synthetic oligonucleotide
atctttcgcttttttttcccg

SEQ ID NO: 7285 - DNA, 20 bp, Artificial Sequence
  Description of Artificial Sequence: Synthetic oligonucleotide
tcttttactttttttctccg

SEQ ID NO: 7286 - DNA, 21 bp, Artificial Sequence
  Description of Artificial Sequence: Synthetic oligonucleotide
ttttattcacttttttgtccc

SEQ ID NO: 7287 - DNA, 20 bp, Artificial Sequence
  Description of Artificial Sequence: Synthetic oligonucleotide
gttttactttgctcctgccg

SEQ ID NO: 7288 - DNA, 20 bp, Artificial Sequence
  Description of Artificial Sequence: Synthetic oligonucleotide
cctttattcacttttttccg

SEQ ID NO: 7289 - DNA, 20 bp, Artificial Sequence
  Description of Artificial Sequence: Synthetic oligonucleotide
attttctcttctttctgccg

SEQ ID NO: 7290 - DNA, 20 bp, Artificial Sequence
  Description of Artificial Sequence: Synthetic oligonucleotide
tttgttttatttttgtcccc

SEQ ID NO: 7291 - DNA, 20 bp, Artificial Sequence
  Description of Artificial Sequence: Synthetic oligonucleotide
ctacattttcttctcctccg

SEQ ID NO: 7292 - DNA, 20 bp, Artificial Sequence
  Description of Artificial Sequence: Synthetic oligonucleotide
cacaggagtagggtggtagc

SEQ ID NO: 7293 - DNA, 20 bp, Artificial Sequence
  Description of Artificial Sequence: Synthetic oligonucleotide
ctttatctcatctcgctccg

SEQ ID NO: 7294 - DNA, 20 bp, Artificial Sequence
  Description of Artificial Sequence: Synthetic oligonucleotide
ttgttttcctgattgttccg

SEQ ID NO: 7295 - DNA, 20 bp, Artificial Sequence
  Description of Artificial Sequence: Synthetic oligonucleotide
ctttttctttatctttgccc

SEQ ID NO: 7296 - DNA, 20 bp, Artificial Sequence
  Description of Artificial Sequence: Synthetic oligonucleotide
tttgaagggagatgggtgcg

SEQ ID NO: 7297 - DNA, 20 bp, Artificial Sequence
  Description of Artificial Sequence: Synthetic oligonucleotide
tttgaagggtggtgagtccg

SEQ ID NO: 7298 - DNA, 21 bp, Artificial Sequence
  Description of Artificial Sequence: Synthetic oligonucleotide
gtttttttgatctcttgtccc

SEQ ID NO: 7299 - DNA, 22 bp, Artificial Sequence
  Description of Artificial Sequence: Synthetic oligonucleotide
atttgctttttttttggttccg

SEQ ID NO: 7300 - DNA, 21 bp, Artificial Sequence
  Description of Artificial Sequence: Synthetic oligonucleotide
catcttcatgctttttttccg

SEQ ID NO: 7301 - DNA, 22 bp, Artificial Sequence
  Description of Artificial Sequence: Synthetic oligonucleotide
acttttttttctctcctttccg

SEQ ID NO: 7302 - DNA, 21 bp, Artificial Sequence
  Description of Artificial Sequence: Synthetic oligonucleotide
gcctttcgttctgccctcccg

SEQ ID NO: 7303 - DNA, 20 bp, Artificial Sequence
  Description of Artificial Sequence: Synthetic oligonucleotide
atctcttctttcttctgccg

SEQ ID NO: 7304 - DNA, 20 bp, Artificial Sequence
  Description of Artificial Sequence: Synthetic oligonucleotide
tttggggggaggggggtccg

SEQ ID NO: 7305 - DNA, 20 bp, Artificial Sequence
  Description of Artificial Sequence: Synthetic oligonucleotide
tttgaaggttgatggggccg

SEQ ID NO: 7306 - DNA, 20 bp, Artificial Sequence
  Description of Artificial Sequence: Synthetic oligonucleotide
tttgaacggggatgggtccg

SEQ ID NO: 7307 - DNA, 20 bp, Artificial Sequence
  Description of Artificial Sequence: Synthetic oligonucleotide
tttgcagggtgatggggccg

SEQ ID NO: 7308 - DNA, 20 bp, Artificial Sequence
  Description of Artificial Sequence: Synthetic oligonucleotide
tttggaggttgatgggtccg

SEQ ID NO: 7309 - DNA, 20 bp, Artificial Sequence
  Description of Artificial Sequence: Synthetic oligonucleotide
ttttcttagccctttgtccg

SEQ ID NO: 7310 - DNA, 20 bp, Artificial Sequence
  Description of Artificial Sequence: Synthetic oligonucleotide
acactttcttactttctcac

SEQ ID NO: 7311 - DNA, 20 bp, Artificial Sequence
  Description of Artificial Sequence: Synthetic oligonucleotide
cttaggagtagggtggtagc

SEQ ID NO: 7312 - DNA, 21 bp, Artificial Sequence
  Description of Artificial Sequence: Synthetic oligonucleotide
tattttactaacctttttccg

SEQ ID NO: 7313 - DNA, 19 bp, Artificial Sequence
  Description of Artificial Sequence: Synthetic oligonucleotide
tttctttcgtttttctccg

SEQ ID NO: 7314 - DNA, 21 bp, Artificial Sequence
  Description of Artificial Sequence: Synthetic oligonucleotide
ttatttaaattttttgttgtg

SEQ ID NO: 7315 - DNA, 20 bp, Artificial Sequence
  Description of Artificial Sequence: Synthetic oligonucleotide
tatcctttttcttttttgcc

SEQ ID NO: 7316 - DNA, 20 bp, Artificial Sequence
  Description of Artificial Sequence: Synthetic oligonucleotide
acctttaacgtttcattccg

SEQ ID NO: 7317 - DNA, 21 bp, Artificial Sequence
  Description of Artificial Sequence: Synthetic oligonucleotide
ttctttgttttttttctcccg

SEQ ID NO: 7318 - DNA, 19 bp, Artificial Sequence
  Description of Artificial Sequence: Synthetic oligonucleotide
tttgtttattttttttccg

SEQ ID NO: 7319 - DNA, 22 bp, Artificial Sequence
  Description of Artificial Sequence: Synthetic oligonucleotide
tacctattctcgtttttttgcc

SEQ ID NO: 7320 - DNA, 20 bp, Artificial Sequence
  Description of Artificial Sequence: Synthetic oligonucleotide
tttttatgttttctcgtcgc

SEQ ID NO: 7321 - DNA, 20 bp, Artificial Sequence
  Description of Artificial Sequence: Synthetic oligonucleotide
ttttgttttttttttctgcc

SEQ ID NO: 7322 - DNA, 19 bp, Artificial Sequence
  Description of Artificial Sequence: Synthetic oligonucleotide
tcttatttttctctctccg

SEQ ID NO: 7323 - DNA, 20 bp, Artificial Sequence
  Description of Artificial Sequence: Synthetic oligonucleotide
tttgaagggccatgggtccg

SEQ ID NO: 7324 - DNA, 19 bp, Artificial Sequence
  Description of Artificial Sequence: Synthetic oligonucleotide
cctttactttttttctccg

SEQ ID NO: 7325 - DNA, 20 bp, Artificial Sequence
  Description of Artificial Sequence: Synthetic oligonucleotide
ccatttaattttttctcccg

SEQ ID NO: 7326 - DNA, 21 bp, Artificial Sequence
  Description of Artificial Sequence: Synthetic oligonucleotide
tattttctctttacttttccc

SEQ ID NO: 7327 - DNA, 20 bp, Artificial Sequence
  Description of Artificial Sequence: Synthetic oligonucleotide
ttttattttctcttcattgg

SEQ ID NO: 7328 - DNA, 19 bp, Artificial Sequence
  Description of Artificial Sequence: Synthetic oligonucleotide
ttctttcttcttttctccg

SEQ ID NO: 7329 - DNA, 20 bp, Artificial Sequence
  Description of Artificial Sequence: Synthetic oligonucleotide
tttgaagggtaatgggcccg

SEQ ID NO: 7330 - DNA, 20 bp, Artificial Sequence
  Description of Artificial Sequence: Synthetic oligonucleotide
ttagaagggcgatgggtccg

SEQ ID NO: 7331 - DNA, 20 bp, Artificial Sequence
  Description of Artificial Sequence: Synthetic oligonucleotide
tttgcggggtgatgggtccg

SEQ ID NO: 7332 - DNA, 20 bp, Artificial Sequence
  Description of Artificial Sequence: Synthetic oligonucleotide
tctattcctccctgccgccc

SEQ ID NO: 7333 - DNA, 21 bp, Artificial Sequence
  Description of Artificial Sequence: Synthetic oligonucleotide
ttcatttctttccacgttccg

SEQ ID NO: 7334 - DNA, 19 bp, Artificial Sequence
  Description of Artificial Sequence: Synthetic oligonucleotide
tttgggagtaggggttccg

SEQ ID NO: 7335 - DNA, 20 bp, Artificial Sequence
  Description of Artificial Sequence: Synthetic oligonucleotide
attctctttcttttccaccg

SEQ ID NO: 7336 - DNA, 20 bp, Artificial Sequence
  Description of Artificial Sequence: Synthetic oligonucleotide
acatgactgatcatgtgccc

SEQ ID NO: 7337 - DNA, 20 bp, Artificial Sequence
  Description of Artificial Sequence: Synthetic oligonucleotide
tcctttcgttctgcgctccc

SEQ ID NO: 7338 - DNA, 20 bp, Artificial Sequence
  Description of Artificial Sequence: Synthetic oligonucleotide
tcctgtcgtctgttctaccc

SEQ ID NO: 7339 - DNA, 21 bp, Artificial Sequence
  Description of Artificial Sequence: Synthetic oligonucleotide
tttgggagtagggtggtacct

SEQ ID NO: 7340 - DNA, 20 bp, Artificial Sequence
  Description of Artificial Sequence: Synthetic oligonucleotide
tcctttcgttctgcccgccc

SEQ ID NO: 7341 - DNA, 20 bp, Artificial Sequence
  Description of Artificial Sequence: Synthetic oligonucleotide
tcctgtcggctattcgtccc

SEQ ID NO: 7342 - DNA, 20 bp, Artificial Sequence
  Description of Artificial Sequence: Synthetic oligonucleotide
gttgttttacctccccgccc

SEQ ID NO: 7343 - DNA, 21 bp, Artificial Sequence
  Description of Artificial Sequence: Synthetic oligonucleotide
gcctattcgttctgccctccc

SEQ ID NO: 7344 - DNA, 20 bp, Artificial Sequence
  Description of Artificial Sequence: Synthetic oligonucleotide
cccacttcttctctattccg

SEQ ID NO: 7345 - DNA, 20 bp, Artificial Sequence
  Description of Artificial Sequence: Synthetic oligonucleotide
atttattaccccttttgccc

SEQ ID NO: 7346 - DNA, 20 bp, Artificial Sequence
  Description of Artificial Sequence: Synthetic oligonucleotide
tctttttaaccttttctccg

SEQ ID NO: 7347 - DNA, 20 bp, Artificial Sequence
  Description of Artificial Sequence: Synthetic oligonucleotide
tattctcttgcttttctccg

SEQ ID NO: 7348 - DNA, 21 bp, Artificial Sequence
  Description of Artificial Sequence: Synthetic oligonucleotide
cattctctttttttcttgccc

SEQ ID NO: 7349 - DNA, 21 bp, Artificial Sequence
  Description of Artificial Sequence: Synthetic oligonucleotide
attcacttctttttcttgccg

SEQ ID NO: 7350 - DNA, 18 bp, Artificial Sequence
  Description of Artificial Sequence: Synthetic oligonucleotide
gcttttcgttgccctccc

SEQ ID NO: 7351 - DNA, 20 bp, Artificial Sequence
  Description of Artificial Sequence: Synthetic oligonucleotide
acatgtaataccagtggccc

SEQ ID NO: 7352 - DNA, 18 bp, Artificial Sequence
  Description of Artificial Sequence: Synthetic oligonucleotide
atttctctttctttgccg

SEQ ID NO: 7353 - DNA, 19 bp, Artificial Sequence
  Description of Artificial Sequence: Synthetic oligonucleotide
cctttcgttctgccccccc

SEQ ID NO: 7354 - DNA, 20 bp, Artificial Sequence
  Description of Artificial Sequence: Synthetic oligonucleotide
tcctttcgatctgccctccc

SEQ ID NO: 7355 - DNA, 19 bp, Artificial Sequence
  Description of Artificial Sequence: Synthetic oligonucleotide
gctttcgttctgctctccc

SEQ ID NO: 7356 - DNA, 19 bp, Artificial Sequence
  Description of Artificial Sequence: Synthetic oligonucleotide
tccttatgttcctcctgcc

SEQ ID NO: 7357 - DNA, 20 bp, Artificial Sequence
  Description of Artificial Sequence: Synthetic oligonucleotide
tctgaagggtgttgggtccg

SEQ ID NO: 7358 - DNA, 20 bp, Artificial Sequence
  Description of Artificial Sequence: Synthetic oligonucleotide
aagatgaggtggctcgtgcc

SEQ ID NO: 7359 - DNA, 20 bp, Artificial Sequence
  Description of Artificial Sequence: Synthetic oligonucleotide
tctaacgttccttccgtccc

SEQ ID NO: 7360 - DNA, 19 bp, Artificial Sequence
  Description of Artificial Sequence: Synthetic oligonucleotide
ttgaagtgtgatgggtccg

SEQ ID NO: 7361 - DNA, 20 bp, Artificial Sequence
  Description of Artificial Sequence: Synthetic oligonucleotide
ttcttcaaatgttttccccg

SEQ ID NO: 7362 - DNA, 20 bp, Artificial Sequence
  Description of Artificial Sequence: Synthetic oligonucleotide
tattttcttccttttctccg

SEQ ID NO: 7363 - DNA, 20 bp, Artificial Sequence
  Description of Artificial Sequence: Synthetic oligonucleotide
gcctttattttccatctccg

SEQ ID NO: 7364 - DNA, 20 bp, Artificial Sequence
  Description of Artificial Sequence: Synthetic oligonucleotide
tttgaagggtgttggctccg

SEQ ID NO: 7365 - DNA, 20 bp, Artificial Sequence
  Description of Artificial Sequence: Synthetic oligonucleotide
attatcttttccttgttccg

SEQ ID NO: 7366 - DNA, 20 bp, Artificial Sequence
  Description of Artificial Sequence: Synthetic oligonucleotide
tttgatgggtgctgggtccg

SEQ ID NO: 7367 - DNA, 20 bp, Artificial Sequence
  Description of Artificial Sequence: Synthetic oligonucleotide
tcacaccttttctctatccg

SEQ ID NO: 7368 - DNA, 20 bp, Artificial Sequence
  Description of Artificial Sequence: Synthetic oligonucleotide
tcttattcttctcttctccg

SEQ ID NO: 7369 - DNA, 20 bp, Artificial Sequence
  Description of Artificial Sequence: Synthetic oligonucleotide
cctttcttccactttttgcc

SEQ ID NO: 7370 - DNA, 20 bp, Artificial Sequence
  Description of Artificial Sequence: Synthetic oligonucleotide
tatttacttctttttgtccg

SEQ ID NO: 7371 - DNA, 20 bp, Artificial Sequence
  Description of Artificial Sequence: Synthetic oligonucleotide
tgttttcttcttctactgcc

SEQ ID NO: 7372 - DNA, 20 bp, Artificial Sequence
  Description of Artificial Sequence: Synthetic oligonucleotide
ttatgtttgtcctttttccg

SEQ ID NO: 7373 - DNA, 20 bp, Artificial Sequence
  Description of Artificial Sequence: Synthetic oligonucleotide
ttcgaaaggtgatgggtccg

SEQ ID NO: 7374 - DNA, 20 bp, Artificial Sequence
  Description of Artificial Sequence: Synthetic oligonucleotide
ttcttaccgtcttcttgccg

SEQ ID NO: 7375 - DNA, 20 bp, Artificial Sequence
  Description of Artificial Sequence: Synthetic oligonucleotide
acctttttgttcgctttccg

SEQ ID NO: 7376 - DNA, 20 bp, Artificial Sequence
  Description of Artificial Sequence: Synthetic oligonucleotide
gcctttctttctaccctccc

SEQ ID NO: 7377 - DNA, 20 bp, Artificial Sequence
  Description of Artificial Sequence: Synthetic oligonucleotide
tcttatctattttcccgccc

SEQ ID NO: 7378 - DNA, 20 bp, Artificial Sequence
  Description of Artificial Sequence: Synthetic oligonucleotide
gcctttcgttcttcccttcc

SEQ ID NO: 7379 - DNA, 20 bp, Artificial Sequence
  Description of Artificial Sequence: Synthetic oligonucleotide
cattttccttattttcggcc

SEQ ID NO: 7380 - DNA, 21 bp, Artificial Sequence
  Description of Artificial Sequence: Synthetic oligonucleotide
atggtgtgttttatgcggctg

SEQ ID NO: 7381 - DNA, 20 bp, Artificial Sequence
  Description of Artificial Sequence: Synthetic oligonucleotide
gttggtgtaggagggttccg

SEQ ID NO: 7382 - DNA, 20 bp, Artificial Sequence
  Description of Artificial Sequence: Synthetic oligonucleotide
cttatggagtagggaggggc

SEQ ID NO: 7383 - DNA, 20 bp, Artificial Sequence
  Description of Artificial Sequence: Synthetic oligonucleotide
ctgtttttcctgtttgtccc

SEQ ID NO: 7384 - DNA, 20 bp, Artificial Sequence
  Description of Artificial Sequence: Synthetic oligonucleotide
tcctggctcgtcgttgtccc

SEQ ID NO: 7385 - DNA, 21 bp, Artificial Sequence
  Description of Artificial Sequence: Synthetic oligonucleotide
gcctttcgttctgccctgccc

SEQ ID NO: 7386 - DNA, 20 bp, Artificial Sequence
  Description of Artificial Sequence: Synthetic oligonucleotide
acagtgtaatgatctgtgcc

SEQ ID NO: 7387 - DNA, 20 bp, Artificial Sequence
  Description of Artificial Sequence: Synthetic oligonucleotide
tttgaacggtgatgggcccg

SEQ ID NO: 7388 - DNA, 20 bp, Artificial Sequence
  Description of Artificial Sequence: Synthetic oligonucleotide
tttggggggaggtgggtccg

SEQ ID NO: 7389 - DNA, 20 bp, Artificial Sequence
  Description of Artificial Sequence: Synthetic oligonucleotide
tttactttttctccatgccc

SEQ ID NO: 7390 - DNA, 22 bp, Artificial Sequence
  Description of Artificial Sequence: Synthetic oligonucleotide
tttactcgttatttttttgccg

SEQ ID NO: 7391 - DNA, 20 bp, Artificial Sequence
  Description of Artificial Sequence: Synthetic oligonucleotide
tctacatttctcttcttgcc

SEQ ID NO: 7392 - DNA, 20 bp, Artificial Sequence
  Description of Artificial Sequence: Synthetic oligonucleotide
tccttgctcgtcttacactg

SEQ ID NO: 7393 - DNA, 19 bp, Artificial Sequence
  Description of Artificial Sequence: Synthetic oligonucleotide
aatttctcgttttttgctg

SEQ ID NO: 7394 - DNA, 20 bp, Artificial Sequence
  Description of Artificial Sequence: Synthetic oligonucleotide
ttttcatcatatttctccgc

SEQ ID NO: 7395 - DNA, 19 bp, Artificial Sequence
  Description of Artificial Sequence: Synthetic oligonucleotide
ttgtttttctctttttccg

SEQ ID NO: 7396 - DNA, 20 bp, Artificial Sequence
  Description of Artificial Sequence: Synthetic oligonucleotide
ttgttttcagtgtttgtccg

SEQ ID NO: 7397 - DNA, 20 bp, Artificial Sequence
  Description of Artificial Sequence: Synthetic oligonucleotide
attatcttttccacttaccc

SEQ ID NO: 7398 - DNA, 20 bp, Artificial Sequence
  Description of Artificial Sequence: Synthetic oligonucleotide
gactttttaattccttaccc

SEQ ID NO: 7399 - DNA, 22 bp, Artificial Sequence
  Description of Artificial Sequence: Synthetic oligonucleotide
tctctttattttttttcttccg

SEQ ID NO: 7400 - DNA, 20 bp, Artificial Sequence
  Description of Artificial Sequence: Synthetic oligonucleotide
gagtttgtatgtttttgccc

SEQ ID NO: 7401 - DNA, 21 bp, Artificial Sequence
  Description of Artificial Sequence: Synthetic oligonucleotide
ctttttgctcttttttctccg

SEQ ID NO: 7402 - DNA, 20 bp, Artificial Sequence
  Description of Artificial Sequence: Synthetic oligonucleotide
aattttattttacctcactg

SEQ ID NO: 7403 - DNA, 20 bp, Artificial Sequence
  Description of Artificial Sequence: Synthetic oligonucleotide
ccattttacgtttacttccg

SEQ ID NO: 7404 - DNA, 20 bp, Artificial Sequence
  Description of Artificial Sequence: Synthetic oligonucleotide
cttatatatcactttctccg

SEQ ID NO: 7405 - DNA, 20 bp, Artificial Sequence
  Description of Artificial Sequence: Synthetic oligonucleotide
aatttttcactttttaaccc

SEQ ID NO: 7406 - DNA, 21 bp, Artificial Sequence
  Description of Artificial Sequence: Synthetic oligonucleotide
agtattttttctccgtttccg

SEQ ID NO: 7407 - DNA, 20 bp, Artificial Sequence
  Description of Artificial Sequence: Synthetic oligonucleotide
ttttctacgttgcttttccc

SEQ ID NO: 7408 - DNA, 19 bp, Artificial Sequence
  Description of Artificial Sequence: Synthetic oligonucleotide
ctttttttattcgtctccg

SEQ ID NO: 7409 - DNA, 20 bp, Artificial Sequence
  Description of Artificial Sequence: Synthetic oligonucleotide
ctcttttcaatgttttaccg

SEQ ID NO: 7410 - DNA, 20 bp, Artificial Sequence
  Description of Artificial Sequence: Synthetic oligonucleotide
gtctttctttcatttttccc

SEQ ID NO: 7411 - DNA, 20 bp, Artificial Sequence
  Description of Artificial Sequence: Synthetic oligonucleotide
ctttgctttatcttcttccg

SEQ ID NO: 7412 - DNA, 18 bp, Artificial Sequence
  Description of Artificial Sequence: Synthetic oligonucleotide
tgtttgtttttttttgtg

SEQ ID NO: 7413 - DNA, 20 bp, Artificial Sequence
  Description of Artificial Sequence: Synthetic oligonucleotide
ttgtctattctctttcgccg

SEQ ID NO: 7414 - DNA, 20 bp, Artificial Sequence
  Description of Artificial Sequence: Synthetic oligonucleotide
acttttctctactttcaccg

SEQ ID NO: 7415 - DNA, 20 bp, Artificial Sequence
  Description of Artificial Sequence: Synthetic oligonucleotide
gaacttattctttttcgccc

SEQ ID NO: 7416 - DNA, 20 bp, Artificial Sequence
  Description of Artificial Sequence: Synthetic oligonucleotide
atcttatgctattttctccg

SEQ ID NO: 7417 - DNA, 20 bp, Artificial Sequence
  Description of Artificial Sequence: Synthetic oligonucleotide
tttgtagggtgctgggtccg

SEQ ID NO: 7418 - DNA, 20 bp, Artificial Sequence
  Description of Artificial Sequence: Synthetic oligonucleotide
gtatgtttttatttgttccg

SEQ ID NO: 7419 - DNA, 20 bp, Artificial Sequence
  Description of Artificial Sequence: Synthetic oligonucleotide
atttgtttattctccttccg

SEQ ID NO: 7420 - DNA, 21 bp, Artificial Sequence
  Description of Artificial Sequence: Synthetic oligonucleotide
ttttttcattttaccgttccg

SEQ ID NO: 7421 - DNA, 20 bp, Artificial Sequence
  Description of Artificial Sequence: Synthetic oligonucleotide
catcttattctttccaaccg

SEQ ID NO: 7422 - DNA, 21 bp, Artificial Sequence
  Description of Artificial Sequence: Synthetic oligonucleotide
agtttactatctctgtttccg

SEQ ID NO: 7423 - DNA, 20 bp, Artificial Sequence
  Description of Artificial Sequence: Synthetic oligonucleotide
ttgtttttgtttgtgtcccg

SEQ ID NO: 7424 - DNA, 21 bp, Artificial Sequence
  Description of Artificial Sequence: Synthetic oligonucleotide
tttttttattcaccttctccg

SEQ ID NO: 7425 - DNA, 20 bp, Artificial Sequence
  Description of Artificial Sequence: Synthetic oligonucleotide
tttgctccttcttatttccg

SEQ ID NO: 7426 - DNA, 20 bp, Artificial Sequence
  Description of Artificial Sequence: Synthetic oligonucleotide
gctgttatttttgttatccg

SEQ ID NO: 7427 - DNA, 20 bp, Artificial Sequence
  Description of Artificial Sequence: Synthetic oligonucleotide
actgatttctcttttacccc

SEQ ID NO: 7428 - DNA, 20 bp, Artificial Sequence
  Description of Artificial Sequence: Synthetic oligonucleotide
ctcttaccatgctttctccg

SEQ ID NO: 7429 - DNA, 21 bp, Artificial Sequence
  Description of Artificial Sequence: Synthetic oligonucleotide
gatttgttttttgttttgtgc

SEQ ID NO: 7430 - DNA, 21 bp, Artificial Sequence
  Description of Artificial Sequence: Synthetic oligonucleotide
ttttatcttttgttttttgcg

SEQ ID NO: 7431 - DNA, 22 bp, Artificial Sequence
  Description of Artificial Sequence: Synthetic oligonucleotide
tttgtttttctctttttttccg

SEQ ID NO: 7432 - DNA, 20 bp, Artificial Sequence
  Description of Artificial Sequence: Synthetic oligonucleotide
tcatcttatattcctttccg

SEQ ID NO: 7433 - DNA, 20 bp, Artificial Sequence
  Description of Artificial Sequence: Synthetic oligonucleotide
tattttcgagtatttttccg

SEQ ID NO: 7434 - DNA, 20 bp, Artificial Sequence
  Description of Artificial Sequence: Synthetic oligonucleotide
gtttcccttgtttgcttccg

SEQ ID NO: 7435 - DNA, 20 bp, Artificial Sequence
  Description of Artificial Sequence: Synthetic oligonucleotide
agaggaggagttgggatctg

SEQ ID NO: 7436 - DNA, 20 bp, Artificial Sequence
  Description of Artificial Sequence: Synthetic oligonucleotide
aatttacattactctttgcc

SEQ ID NO: 7437 - DNA, 20 bp, Artificial Sequence
  Description of Artificial Sequence: Synthetic oligonucleotide
gcccttctcgtcttatactg

SEQ ID NO: 7438 - DNA, 20 bp, Artificial Sequence
  Description of Artificial Sequence: Synthetic oligonucleotide
atctttattttttttctccg

SEQ ID NO: 7439 - DNA, 20 bp, Artificial Sequence
  Description of Artificial Sequence: Synthetic oligonucleotide
acccttttattttcttgccg

SEQ ID NO: 7440 - DNA, 19 bp, Artificial Sequence
  Description of Artificial Sequence: Synthetic oligonucleotide
tactttttttttctctccg

SEQ ID NO: 7441 - DNA, 20 bp, Artificial Sequence
  Description of Artificial Sequence: Synthetic oligonucleotide
ccttttacttttcttctccg

SEQ ID NO: 7442 - DNA, 20 bp, Artificial Sequence
  Description of Artificial Sequence: Synthetic oligonucleotide
ctttacttctttcctttccc

SEQ ID NO: 7443 - DNA, 21 bp, Artificial Sequence
  Description of Artificial Sequence: Synthetic oligonucleotide
accgctgtttatttttttccg

SEQ ID NO: 7444 - DNA, 20 bp, Artificial Sequence
  Description of Artificial Sequence: Synthetic oligonucleotide
tcccatttcatttcttgccc

SEQ ID NO: 7445 - DNA, 19 bp, Artificial Sequence
  Description of Artificial Sequence: Synthetic oligonucleotide
attcgcttactatttaccg

SEQ ID NO: 7446 - DNA, 20 bp, Artificial Sequence
  Description of Artificial Sequence: Synthetic oligonucleotide
ccttattttttgtttcccac

SEQ ID NO: 7447 - DNA, 20 bp, Artificial Sequence
  Description of Artificial Sequence: Synthetic oligonucleotide
attatttgtttcaccttcac

SEQ ID NO: 7448 - DNA, 20 bp, Artificial Sequence
  Description of Artificial Sequence: Synthetic oligonucleotide
gcctttcgtttcgccctccc

SEQ ID NO: 7449 - DNA, 21 bp, Artificial Sequence
  Description of Artificial Sequence: Synthetic oligonucleotide
gtcctgtcgtctgtctgtccc

SEQ ID NO: 7450 - DNA, 20 bp, Artificial Sequence
  Description of Artificial Sequence: Synthetic oligonucleotide
gcctttcgctcttccctccc

SEQ ID NO: 7451 - DNA, 20 bp, Artificial Sequence
  Description of Artificial Sequence: Synthetic oligonucleotide
cactctcttcattcactccg

SEQ ID NO: 7452 - DNA, 20 bp, Artificial Sequence
  Description of Artificial Sequence: Synthetic oligonucleotide
gcctttcgttctgcccctcc

SEQ ID NO: 7453 - DNA, 20 bp, Artificial Sequence
  Description of Artificial Sequence: Synthetic oligonucleotide
gtcttctggtttatcgtccc

SEQ ID NO: 7454 - DNA, 20 bp, Artificial Sequence
  Description of Artificial Sequence: Synthetic oligonucleotide
cttattttcacttgctaccc

SEQ ID NO: 7455 - DNA, 21 bp, Artificial Sequence
  Description of Artificial Sequence: Synthetic oligonucleotide
tttttcacttttttcgccccc

SEQ ID NO: 7456 - DNA, 20 bp, Artificial Sequence
  Description of Artificial Sequence: Synthetic oligonucleotide
tctttttattctatcccctg

SEQ ID NO: 7457 - DNA, 20 bp, Artificial Sequence
  Description of Artificial Sequence: Synthetic oligonucleotide
tttattgttttcttcgtgcc

SEQ ID NO: 7458 - DNA, 20 bp, Artificial Sequence
  Description of Artificial Sequence: Synthetic oligonucleotide
tcttgtttgttctttctccg

SEQ ID NO: 7459 - DNA, 20 bp, Artificial Sequence
  Description of Artificial Sequence: Synthetic oligonucleotide
cctttcttcgctttttaccg

SEQ ID NO: 7460 - DNA, 20 bp, Artificial Sequence
  Description of Artificial Sequence: Synthetic oligonucleotide
atattctagttttctttgcc

SEQ ID NO: 7461 - DNA, 21 bp, Artificial Sequence
  Description of Artificial Sequence: Synthetic oligonucleotide
tttttgttattttttgctctg

SEQ ID NO: 7462 - DNA, 20 bp, Artificial Sequence
  Description of Artificial Sequence: Synthetic oligonucleotide
atccttgctatttctctctg

SEQ ID NO: 7463 - DNA, 20 bp, Artificial Sequence
  Description of Artificial Sequence: Synthetic oligonucleotide
cctattccttttcacctccg

SEQ ID NO: 7464 - DNA, 20 bp, Artificial Sequence
  Description of Artificial Sequence: Synthetic oligonucleotide
tctttatttctcttgttcgc

SEQ ID NO: 7465 - DNA, 21 bp, Artificial Sequence
  Description of Artificial Sequence: Synthetic oligonucleotide
aatactcttttttttccaccg

SEQ ID NO: 7466 - DNA, 20 bp, Artificial Sequence
  Description of Artificial Sequence: Synthetic oligonucleotide
ttttttattctctcgctgcg

SEQ ID NO: 7467 - DNA, 19 bp, Artificial Sequence
  Description of Artificial Sequence: Synthetic oligonucleotide
acctttcgttctgcctccc

SEQ ID NO: 7468 - DNA, 21 bp, Artificial Sequence
  Description of Artificial Sequence: Synthetic oligonucleotide
attcttttttgtttttttgcc

SEQ ID NO: 7469 - DNA, 20 bp, Artificial Sequence
  Description of Artificial Sequence: Synthetic oligonucleotide
tttggagggttatgggtccg

SEQ ID NO: 7470 - DNA, 20 bp, Artificial Sequence
  Description of Artificial Sequence: Synthetic oligonucleotide
tatcgtatttcccttgtcgc

SEQ ID NO: 7471 - DNA, 20 bp, Artificial Sequence
  Description of Artificial Sequence: Synthetic oligonucleotide
tttgaaggggcatgggtccg

SEQ ID NO: 7472 - DNA, 20 bp, Artificial Sequence
  Description of Artificial Sequence: Synthetic oligonucleotide
ttataggagtggtggtggtg

SEQ ID NO: 7473 - DNA, 19 bp, Artificial Sequence
  Description of Artificial Sequence: Synthetic oligonucleotide
tacttcttttttctctccg

SEQ ID NO: 7474 - DNA, 20 bp, Artificial Sequence
  Description of Artificial Sequence: Synthetic oligonucleotide
tttgaagggtgattgctccg

SEQ ID NO: 7475 - DNA, 20 bp, Artificial Sequence
  Description of Artificial Sequence: Synthetic oligonucleotide
tttgatgggtgatggctccg

SEQ ID NO: 7476 - DNA, 20 bp, Artificial Sequence
  Description of Artificial Sequence: Synthetic oligonucleotide
attgcagggtgatgggtccg

SEQ ID NO: 7477 - DNA, 20 bp, Artificial Sequence
  Description of Artificial Sequence: Synthetic oligonucleotide
tcacttacttttttcctccg

SEQ ID NO: 7478 - DNA, 20 bp, Artificial Sequence
  Description of Artificial Sequence: Synthetic oligonucleotide
atttcctcttttttctgccg

SEQ ID NO: 7479 - DNA, 20 bp, Artificial Sequence
  Description of Artificial Sequence: Synthetic oligonucleotide
tattaggagtaggtagggtg

SEQ ID NO: 7480 - DNA, 19 bp, Artificial Sequence
  Description of Artificial Sequence: Synthetic oligonucleotide
tctttttatttgctttccg

SEQ ID NO: 7481 - DNA, 20 bp, Artificial Sequence
  Description of Artificial Sequence: Synthetic oligonucleotide
ccttttacttcttttctccg

SEQ ID NO: 7482 - DNA, 20 bp, Artificial Sequence
  Description of Artificial Sequence: Synthetic oligonucleotide
tctttgtcttgttttttccg

SEQ ID NO: 7483 - DNA, 20 bp, Artificial Sequence
  Description of Artificial Sequence: Synthetic oligonucleotide
ttttacatttactttttcgc

SEQ ID NO: 7484 - DNA, 20 bp, Artificial Sequence
  Description of Artificial Sequence: Synthetic oligonucleotide
gttcttactttcttttcgcc

SEQ ID NO: 7485 - DNA, 21 bp, Artificial Sequence
  Description of Artificial Sequence: Synthetic oligonucleotide
cttttttgctctttttctccg

SEQ ID NO: 7486 - DNA, 20 bp, Artificial Sequence
  Description of Artificial Sequence: Synthetic oligonucleotide
atctacattacttcttaccc

SEQ ID NO: 7487 - DNA, 20 bp, Artificial Sequence
  Description of Artificial Sequence: Synthetic oligonucleotide
gttgttttattttttgtccc

SEQ ID NO: 7488 - DNA, 22 bp, Artificial Sequence
  Description of Artificial Sequence: Synthetic oligonucleotide
attccactttttttttccaccg

SEQ ID NO: 7489 - DNA, 19 bp, Artificial Sequence
  Description of Artificial Sequence: Synthetic oligonucleotide
tttatattttgtgcttctc

SEQ ID NO: 7490 - DNA, 18 bp, Artificial Sequence
  Description of Artificial Sequence: Synthetic oligonucleotide
tttctctttttctttccg

SEQ ID NO: 7491 - DNA, 20 bp, Artificial Sequence
  Description of Artificial Sequence: Synthetic oligonucleotide
ttttaagggtgctgggtccg

SEQ ID NO: 7492 - DNA, 20 bp, Artificial Sequence
  Description of Artificial Sequence: Synthetic oligonucleotide
ttatgtttctcccgtggccg

SEQ ID NO: 7493 - DNA, 22 bp, Artificial Sequence
  Description of Artificial Sequence: Synthetic oligonucleotide
agttttttgtctttttttcccc

SEQ ID NO: 7494 - DNA, 20 bp, Artificial Sequence
  Description of Artificial Sequence: Synthetic oligonucleotide
tttccatttcattatttccc

SEQ ID NO: 7495 - DNA, 20 bp, Artificial Sequence
  Description of Artificial Sequence: Synthetic oligonucleotide
tttactttacattttgccca

SEQ ID NO: 7496 - DNA, 21 bp, Artificial Sequence
  Description of Artificial Sequence: Synthetic oligonucleotide
tttgtttttattttttgtccc

SEQ ID NO: 7497 - DNA, 20 bp, Artificial Sequence
  Description of Artificial Sequence: Synthetic oligonucleotide
tttgaagggcgatgggttcg

SEQ ID NO: 7498 - DNA, 22 bp, Artificial Sequence
  Description of Artificial Sequence: Synthetic oligonucleotide
tctatttggtactttttttccg

SEQ ID NO: 7499 - DNA, 20 bp, Artificial Sequence
  Description of Artificial Sequence: Synthetic oligonucleotide
ttcgtcactgctcctgtccg

SEQ ID NO: 7500 - DNA, 20 bp, Artificial Sequence
  Description of Artificial Sequence: Synthetic oligonucleotide
tctttactttctctttgccc

SEQ ID NO: 7501 - DNA, 20 bp, Artificial Sequence
  Description of Artificial Sequence: Synthetic oligonucleotide
tttgatcaattctccctgcc

SEQ ID NO: 7502 - DNA, 20 bp, Artificial Sequence
  Description of Artificial Sequence: Synthetic oligonucleotide
tttgagggttgatgggtccg

SEQ ID NO: 7503 - DNA, 20 bp, Artificial Sequence
  Description of Artificial Sequence: Synthetic oligonucleotide
tcctgtcgtctgctcggccc

SEQ ID NO: 7504 - DNA, 20 bp, Artificial Sequence
  Description of Artificial Sequence: Synthetic oligonucleotide
tttgattctttttgtttccg

SEQ ID NO: 7505 - DNA, 20 bp, Artificial Sequence
  Description of Artificial Sequence: Synthetic oligonucleotide
ttctgtcgtctttgcgtccc

SEQ ID NO: 7506 - DNA, 20 bp, Artificial Sequence
  Description of Artificial Sequence: Synthetic oligonucleotide
aaactagtagtactggtgcc

SEQ ID NO: 7507 - DNA, 20 bp, Artificial Sequence
  Description of Artificial Sequence: Synthetic oligonucleotide
cataggagtaggggggtagc

SEQ ID NO: 7508 - DNA, 19 bp, Artificial Sequence
  Description of Artificial Sequence: Synthetic oligonucleotide
attatcttttcttgttccg

SEQ ID NO: 7509 - DNA, 20 bp, Artificial Sequence
  Description of Artificial Sequence: Synthetic oligonucleotide
tttgcgagtagggtgttccg

SEQ ID NO: 7510 - DNA, 19 bp, Artificial Sequence
  Description of Artificial Sequence: Synthetic oligonucleotide
gcctttcgttctaccctcc

SEQ ID NO: 7511 - DNA, 20 bp, Artificial Sequence
  Description of Artificial Sequence: Synthetic oligonucleotide
gtttattcttttccgctccg

SEQ ID NO: 7512 - DNA, 20 bp, Artificial Sequence
  Description of Artificial Sequence: Synthetic oligonucleotide
aagccaggagatgttgtggc

SEQ ID NO: 7513 - DNA, 20 bp, Artificial Sequence
  Description of Artificial Sequence: Synthetic oligonucleotide
cttaatctacttcctctccg

SEQ ID NO: 7514 - DNA, 20 bp, Artificial Sequence
  Description of Artificial Sequence: Synthetic oligonucleotide
cgattcctccggttcgtccc

SEQ ID NO: 7515 - DNA, 21 bp, Artificial Sequence
  Description of Artificial Sequence: Synthetic oligonucleotide
gtgctcgtctgttttcgtccc

SEQ ID NO: 7516 - DNA, 20 bp, Artificial Sequence
  Description of Artificial Sequence: Synthetic oligonucleotide
acatacttaatgtgtgtccc

SEQ ID NO: 7517 - DNA, 20 bp, Artificial Sequence
  Description of Artificial Sequence: Synthetic oligonucleotide
ttctggcttgtcgttgtccg

SEQ ID NO: 7518 - DNA, 20 bp, Artificial Sequence
  Description of Artificial Sequence: Synthetic oligonucleotide
aacgtgttatttacgtgccc

SEQ ID NO: 7519 - DNA, 21 bp, Artificial Sequence
  Description of Artificial Sequence: Synthetic oligonucleotide
tttttccatattctctgtcct

SEQ ID NO: 7520 - DNA, 20 bp, Artificial Sequence
  Description of Artificial Sequence: Synthetic oligonucleotide
cactacttttctactctccg

SEQ ID NO: 7521 - DNA, 20 bp, Artificial Sequence
  Description of Artificial Sequence: Synthetic oligonucleotide
actttttttcattttttgtg

SEQ ID NO: 7522 - DNA, 20 bp, Artificial Sequence
  Description of Artificial Sequence: Synthetic oligonucleotide
tacttacaattttctctctg

SEQ ID NO: 7523 - DNA, 20 bp, Artificial Sequence
  Description of Artificial Sequence: Synthetic oligonucleotide
attctttcactctatttctg

SEQ ID NO: 7524 - DNA, 20 bp, Artificial Sequence
  Description of Artificial Sequence: Synthetic oligonucleotide
gtcctgtcgccttacgtccc

SEQ ID NO: 7525 - DNA, 19 bp, Artificial Sequence
  Description of Artificial Sequence: Synthetic oligonucleotide
ccattcactttcttttccg

SEQ ID NO: 7526 - DNA, 21 bp, Artificial Sequence
  Description of Artificial Sequence: Synthetic oligonucleotide
ttcacttttttcctcattccg

SEQ ID NO: 7527 - DNA, 21 bp, Artificial Sequence
  Description of Artificial Sequence: Synthetic oligonucleotide
accttttccattttttttccg

SEQ ID NO: 7528 - DNA, 20 bp, Artificial Sequence
  Description of Artificial Sequence: Synthetic oligonucleotide
tctatttaatttctttcctg

SEQ ID NO: 7529 - DNA, 20 bp, Artificial Sequence
  Description of Artificial Sequence: Synthetic oligonucleotide
tcacttttccttttcatcca

SEQ ID NO: 7530 - DNA, 21 bp, Artificial Sequence
  Description of Artificial Sequence: Synthetic oligonucleotide
tttttttgccttctctctccg

SEQ ID NO: 7531 - DNA, 20 bp, Artificial Sequence
  Description of Artificial Sequence: Synthetic oligonucleotide
ttacttcttgttttctcctg

SEQ ID NO: 7532 - DNA, 20 bp, Artificial Sequence
  Description of Artificial Sequence: Synthetic oligonucleotide
tatactcttcattccttccg

SEQ ID NO: 7533 - DNA, 20 bp, Artificial Sequence
  Description of Artificial Sequence: Synthetic oligonucleotide
aatgctcgaccttcctgccg

SEQ ID NO: 7534 - DNA, 20 bp, Artificial Sequence
  Description of Artificial Sequence: Synthetic oligonucleotide
tctctattcttcttttcccc

SEQ ID NO: 7535 - DNA, 20 bp, Artificial Sequence
  Description of Artificial Sequence: Synthetic oligonucleotide
taatttgttgtttatttgtg

SEQ ID NO: 7536 - DNA, 21 bp, Artificial Sequence
  Description of Artificial Sequence: Synthetic oligonucleotide
tctttttttcatttttttccg

SEQ ID NO: 7537 - DNA, 21 bp, Artificial Sequence
  Description of Artificial Sequence: Synthetic oligonucleotide
gtcttttttttccgctccccg

SEQ ID NO: 7538 - DNA, 19 bp, Artificial Sequence
  Description of Artificial Sequence: Synthetic oligonucleotide
cttctttttcttctttccg

SEQ ID NO: 7539 - DNA, 20 bp, Artificial Sequence
  Description of Artificial Sequence: Synthetic oligonucleotide
tctttataattttctccgtg

SEQ ID NO: 7540 - DNA, 21 bp, Artificial Sequence
  Description of Artificial Sequence: Synthetic oligonucleotide
atttcctctttttttctgccg

SEQ ID NO: 7541 - DNA, 19 bp, Artificial Sequence
  Description of Artificial Sequence: Synthetic oligonucleotide
cctttttcttccttttccg

SEQ ID NO: 7542 - DNA, 20 bp, Artificial Sequence
  Description of Artificial Sequence: Synthetic oligonucleotide
tctttaattctcttcacccc

SEQ ID NO: 7543 - DNA, 20 bp, Artificial Sequence
  Description of Artificial Sequence: Synthetic oligonucleotide
atcactatttaattccaccg

SEQ ID NO: 7544 - DNA, 20 bp, Artificial Sequence
  Description of Artificial Sequence: Synthetic oligonucleotide
ttttcattcacttcactctg

SEQ ID NO: 7545 - DNA, 18 bp, Artificial Sequence
  Description of Artificial Sequence: Synthetic oligonucleotide
gttatttcttttttgctg

SEQ ID NO: 7546 - DNA, 20 bp, Artificial Sequence
  Description of Artificial Sequence: Synthetic oligonucleotide
ttcaatcatttcttctcgtg

SEQ ID NO: 7547 - DNA, 20 bp, Artificial Sequence
  Description of Artificial Sequence: Synthetic oligonucleotide
agttccttttctactttccg

SEQ ID NO: 7548 - DNA, 20 bp, Artificial Sequence
  Description of Artificial Sequence: Synthetic oligonucleotide
tcacttagtctttttctctg

SEQ ID NO: 7549 - DNA, 20 bp, Artificial Sequence
  Description of Artificial Sequence: Synthetic oligonucleotide
tattcactcattttactccg

SEQ ID NO: 7550 - DNA, 20 bp, Artificial Sequence
  Description of Artificial Sequence: Synthetic oligonucleotide
ctctttttgcttcttttgcc

SEQ ID NO: 7551 - DNA, 20 bp, Artificial Sequence
  Description of Artificial Sequence: Synthetic oligonucleotide
atttctcttcctttttaccg

SEQ ID NO: 7552 - DNA, 20 bp, Artificial Sequence
  Description of Artificial Sequence: Synthetic oligonucleotide
ccattttctttcatcttccg

SEQ ID NO: 7553 - DNA, 20 bp, Artificial Sequence
  Description of Artificial Sequence: Synthetic oligonucleotide
gattcttcactttttacctg

SEQ ID NO: 7554 - DNA, 20 bp, Artificial Sequence
  Description of Artificial Sequence: Synthetic oligonucleotide
caattgttttttttcaccgc

SEQ ID NO: 7555 - DNA, 20 bp, Artificial Sequence
  Description of Artificial Sequence: Synthetic oligonucleotide
tttgctttattttttgtccc

SEQ ID NO: 7556 - DNA, 20 bp, Artificial Sequence
  Description of Artificial Sequence: Synthetic oligonucleotide
acttatctttctcactaccc

SEQ ID NO: 7557 - DNA, 20 bp, Artificial Sequence
  Description of Artificial Sequence: Synthetic oligonucleotide
ctttttatcagtttctccgc

SEQ ID NO: 7558 - DNA, 20 bp, Artificial Sequence
  Description of Artificial Sequence: Synthetic oligonucleotide
ttaatttattttcagctccc

SEQ ID NO: 7559 - DNA, 20 bp, Artificial Sequence
  Description of Artificial Sequence: Synthetic oligonucleotide
catttacattctttctgcgc

SEQ ID NO: 7560 - DNA, 20 bp, Artificial Sequence
  Description of Artificial Sequence: Synthetic oligonucleotide
attttttttcttttttgccg

SEQ ID NO: 7561 - DNA, 21 bp, Artificial Sequence
  Description of Artificial Sequence: Synthetic oligonucleotide
ttttttcaccttttgcttccg

SEQ ID NO: 7562 - DNA, 20 bp, Artificial Sequence
  Description of Artificial Sequence: Synthetic oligonucleotide
actttctcttatctctgctg

SEQ ID NO: 7563 - DNA, 20 bp, Artificial Sequence
  Description of Artificial Sequence: Synthetic oligonucleotide
ttttccagtttgcttttccc

SEQ ID NO: 7564 - DNA, 20 bp, Artificial Sequence
  Description of Artificial Sequence: Synthetic oligonucleotide
tctatttcgaattctctccg

SEQ ID NO: 7565 - DNA, 20 bp, Artificial Sequence
  Description of Artificial Sequence: Synthetic oligonucleotide
cattttctccattttcggcc

SEQ ID NO: 7566 - DNA, 20 bp, Artificial Sequence
  Description of Artificial Sequence: Synthetic oligonucleotide
ttcattttcccgttttgccg

SEQ ID NO: 7567 - DNA, 20 bp, Artificial Sequence
  Description of Artificial Sequence: Synthetic oligonucleotide
tctttttcgtttttttaccg

SEQ ID NO: 7568 - DNA, 19 bp, Artificial Sequence
  Description of Artificial Sequence: Synthetic oligonucleotide
gcccttcgttctgcctccc

SEQ ID NO: 7569 - DNA, 20 bp, Artificial Sequence
  Description of Artificial Sequence: Synthetic oligonucleotide
ccttacttttttcaccaccc

SEQ ID NO: 7570 - DNA, 20 bp, Artificial Sequence
  Description of Artificial Sequence: Synthetic oligonucleotide
catttgtcctgttttcaccg

SEQ ID NO: 7571 - DNA, 20 bp, Artificial Sequence
  Description of Artificial Sequence: Synthetic oligonucleotide
tatttatttttcttgccccg

SEQ ID NO: 7572 - DNA, 20 bp, Artificial Sequence
  Description of Artificial Sequence: Synthetic oligonucleotide
atttttgttacgttgctccg

SEQ ID NO: 7573 - DNA, 20 bp, Artificial Sequence
  Description of Artificial Sequence: Synthetic oligonucleotide
tttactttcttcttttgccg

SEQ ID NO: 7574 - DNA, 21 bp, Artificial Sequence
  Description of Artificial Sequence: Synthetic oligonucleotide
ttttttgttatttttgctctg

SEQ ID NO: 7575 - DNA, 20 bp, Artificial Sequence
  Description of Artificial Sequence: Synthetic oligonucleotide
ttttacttcctcatttgccg

SEQ ID NO: 7576 - DNA, 22 bp, Artificial Sequence
  Description of Artificial Sequence: Synthetic oligonucleotide
ttttttttcctatctctgtccg

SEQ ID NO: 7577 - DNA, 22 bp, Artificial Sequence
  Description of Artificial Sequence: Synthetic oligonucleotide
ttgccttttatttttttttccg

SEQ ID NO: 7578 - DNA, 19 bp, Artificial Sequence
  Description of Artificial Sequence: Synthetic oligonucleotide
tttttctactctttttccg

SEQ ID NO: 7579 - DNA, 20 bp, Artificial Sequence
  Description of Artificial Sequence: Synthetic oligonucleotide
attctctcttttttctgccg

SEQ ID NO: 7580 - DNA, 20 bp, Artificial Sequence
  Description of Artificial Sequence: Synthetic oligonucleotide
ccttttcttcattttttccg

SEQ ID NO: 7581 - DNA, 19 bp, Artificial Sequence
  Description of Artificial Sequence: Synthetic oligonucleotide
gcctttcgctctgcctccc

SEQ ID NO: 7582 - DNA, 20 bp, Artificial Sequence
  Description of Artificial Sequence: Synthetic oligonucleotide
tttggggtttccccgtgccg

SEQ ID NO: 7583 - DNA, 21 bp, Artificial Sequence
  Description of Artificial Sequence: Synthetic oligonucleotide
gccgtttcgttctgccctccc

SEQ ID NO: 7584 - DNA, 20 bp, Artificial Sequence
  Description of Artificial Sequence: Synthetic oligonucleotide
ttcctgtttcctctgctccc

SEQ ID NO: 7585 - DNA, 20 bp, Artificial Sequence
  Description of Artificial Sequence: Synthetic oligonucleotide
gtcttctggcttattgtccc

SEQ ID NO: 7586 - DNA, 20 bp, Artificial Sequence
  Description of Artificial Sequence: Synthetic oligonucleotide
acagatggatagttggggtc

SEQ ID NO: 7587 - DNA, 20 bp, Artificial Sequence
  Description of Artificial Sequence: Synthetic oligonucleotide
ctgacattatcctgcatgtc

SEQ ID NO: 7588 - DNA, 20 bp, Artificial Sequence
  Description of Artificial Sequence: Synthetic oligonucleotide
tttgggagtagggtgatccg

SEQ ID NO: 7589 - DNA, 22 bp, Artificial Sequence
  Description of Artificial Sequence: Synthetic oligonucleotide
actttattctcttttttttccg

SEQ ID NO: 7590 - DNA, 20 bp, Artificial Sequence
  Description of Artificial Sequence: Synthetic oligonucleotide
tttgaagggtgattgttccg

SEQ ID NO: 7591 - DNA, 21 bp, Artificial Sequence
  Description of Artificial Sequence: Synthetic oligonucleotide
atttctcttcttcttttgccg

SEQ ID NO: 7592 - DNA, 20 bp, Artificial Sequence
  Description of Artificial Sequence: Synthetic oligonucleotide
cttgaagggtgaagggtccg

SEQ ID NO: 7593 - DNA, 20 bp, Artificial Sequence
  Description of Artificial Sequence: Synthetic oligonucleotide
attctcttcttcttttaccg

SEQ ID NO: 7594 - DNA, 20 bp, Artificial Sequence
  Description of Artificial Sequence: Synthetic oligonucleotide
tttgatgggtgacgggtccg

SEQ ID NO: 7595 - DNA, 21 bp, Artificial Sequence
  Description of Artificial Sequence: Synthetic oligonucleotide
tcttctttttttcactttccg

SEQ ID NO: 7596 - DNA, 20 bp, Artificial Sequence
  Description of Artificial Sequence: Synthetic oligonucleotide
tttattttcttgttgttgtg

SEQ ID NO: 7597 - RNA, 51 nt, Artificial Sequence
  Description of Artificial Sequence: Synthetic oligonucleotide
gggaggacgaugcgguuugaagggugauggguccgcagacgacucgcccga

SEQ ID NO: 7598 - RNA, 51 nt, Artificial Sequence
  Description of Artificial Sequence: Synthetic oligonucleotide
gggaggacgaugcgguuggguguagggugguaccgcagacgacucgcccga

SEQ ID NO: 7599 - RNA, 51 nt, Artificial Sequence
  Description of Artificial Sequence: Synthetic oligonucleotide
gggaggacgaugcggauuggugaagggagguacugcagacgacucgcccga

SEQ ID NO: 7600 - RNA, 51 nt, Artificial Sequence
  Description of Artificial Sequence: Synthetic oligonucleotide
gggaggacgaugcgggccuuucguucugcccuccccagacgacucgcccga

SEQ ID NO: 7601 - RNA, 51 nt, Artificial Sequence
  Description of Artificial Sequence: Synthetic oligonucleotide
gggaggacgaugcgggccuuucguucugaccuccccagacgacucgcccga

SEQ ID NO: 7602 - RNA, 51 nt, Artificial Sequence
  Description of Artificial Sequence: Synthetic oligonucleotide
gggaggacgaugcggauuggugaagggagguaccgcagacgacucgcccga

SEQ ID NO: 7603 - RNA, 51 nt, Artificial Sequence
  Description of Artificial Sequence: Synthetic oligonucleotide
gggaggacgaugcggcagaggagaagggagguugccagacgacucgcccga

SEQ ID NO: 7604 - RNA, 51 nt, Artificial Sequence
  Description of Artificial Sequence: Synthetic oligonucleotide
gggaggacgaugcgguguaggaggaggagguaccgcagacgacucgcccga

SEQ ID NO: 7605 - RNA, 51 nt, Artificial Sequence
  Description of Artificial Sequence: Synthetic oligonucleotide
gggaggacgaugcgguccugucgucuguucguccccagacgacucgcccga

SEQ ID NO: 7606 - RNA, 51 nt, Artificial Sequence
  Description of Artificial Sequence: Synthetic oligonucleotide
gggaggacgaugcgguuugaagggugguggguccgcagacgacucgcccga

SEQ ID NO: 7607 - RNA, 51 nt, Artificial Sequence
  Description of Artificial Sequence: Synthetic oligonucleotide
gggaggacgaugcgguauuggagguguagggaccgcagacgacucgcccga

SEQ ID NO: 7608 - RNA, 51 nt, Artificial Sequence
  Description of Artificial Sequence: Synthetic oligonucleotide
gggaggacgaugcgguuugggguuuucccgugccccagacgacucgcccga

SEQ ID NO: 7609 - RNA, 51 nt, Artificial Sequence
  Description of Artificial Sequence: Synthetic oligonucleotide
gggaggacgaugcggauagggagaagggugaaccgcagacgacucgcccga

SEQ ID NO: 7610 - RNA, 51 nt, Artificial Sequence
  Description of Artificial Sequence: Synthetic oligonucleotide
gggaggacgaugcgguuggguguaggguguuaccgcagacgacucgcccga

SEQ ID NO: 7611 - RNA, 51 nt, Artificial Sequence
  Description of Artificial Sequence: Synthetic oligonucleotide
gggaggacgaugcgguuggguguagggugguacugcagacgacucgcccga

SEQ ID NO: 7612 - RNA, 52 nt, Artificial Sequence
  Description of Artificial Sequence: Synthetic oligonucleotide
gggaggacgaugcggguccugucgucuguucguccccagacgacucgcccga

SEQ ID NO: 7613 - RNA, 51 nt, Artificial Sequence
  Description of Artificial Sequence: Synthetic oligonucleotide
gggaggacgaugcgguuugaagggcgauggguccgcagacgacucgcccga

SEQ ID NO: 7614 - RNA, 51 nt, Artificial Sequence
  Description of Artificial Sequence: Synthetic oligonucleotide
gggaggacgaugcgguuugaagggagauggguccgcagacgacucgcccga

SEQ ID NO: 7615 - RNA, 51 nt, Artificial Sequence
  Description of Artificial Sequence: Synthetic oligonucleotide
gggaggacgaugcgguuugaagggggauggguccgcagacgacucgcccga

SEQ ID NO: 7616 - RNA, 51 nt, Artificial Sequence
  Description of Artificial Sequence: Synthetic oligonucleotide
gggaggacgaugcgggucuucuggcuuaucguccccagacgacucgcccga

SEQ ID NO: 7617 - RNA, 51 nt, Artificial Sequence
  Description of Artificial Sequence: Synthetic oligonucleotide
gggaggacgaugcggugacucgucuguuucguccccagacgacucgcccga

SEQ ID NO: 7618 - RNA, 51 nt, Artificial Sequence
  Description of Artificial Sequence: Synthetic oligonucleotide
gggaggacgaugcgguccuugucgucuugcguccccagacgacucgcccga

SEQ ID NO: 7619 - RNA, 51 nt, Artificial Sequence
  Description of Artificial Sequence: Synthetic oligonucleotide
gggaggacgaugcgguuugaagggugauggguccccagacgacucgcccga

SEQ ID NO: 7620 - RNA, 51 nt, Artificial Sequence
  Description of Artificial Sequence: Synthetic oligonucleotide
gggaggacgaugcgguucgaagggugauggguccgcagacgacucgcccga

SEQ ID NO: 7621 - RNA, 51 nt, Artificial Sequence
  Description of Artificial Sequence: Synthetic oligonucleotide
gggaggacgaugcgguguagggagguaguuaucgucagacgacucgcccga

SEQ ID NO: 7622 - RNA, 51 nt, Artificial Sequence
  Description of Artificial Sequence: Synthetic oligonucleotide
gggaggacgaugcggguugaagggugauggguccgcagacgacucgcccga

SEQ ID NO: 7623 - RNA, 50 nt, Artificial Sequence
  Description of Artificial Sequence: Synthetic oligonucleotide
gggaggacgaugcgguugaagggugauggguccgcagacgacucgcccga

SEQ ID NO: 7624 - RNA, 51 nt, Artificial Sequence
  Description of Artificial Sequence: Synthetic oligonucleotide
gggaggacgaugcggcuugucgucuuguucguccccagacgacucgcccga

SEQ ID NO: 7625 - RNA, 51 nt, Artificial Sequence
  Description of Artificial Sequence: Synthetic oligonucleotide
gggaggacgaugcgguuggguguaggguggugccgcagacgacucgcccga

SEQ ID NO: 7626 - RNA, 51 nt, Artificial Sequence
  Description of Artificial Sequence: Synthetic oligonucleotide
gggaggacgaugcggcuugaagggugauggguccgcagacgacucgcccga

SEQ ID NO: 7627 - RNA, 51 nt, Artificial Sequence
  Description of Artificial Sequence: Synthetic oligonucleotide
gggaggacgaugcggcguuuccucugguucguccccagacgacucgcccga

SEQ ID NO: 7628 - RNA, 51 nt, Artificial Sequence
  Description of Artificial Sequence: Synthetic oligonucleotide
gggaggacgaugcgguuugaggggugauggguccgcagacgacucgcccga

SEQ ID NO: 7629 - RNA, 51 nt, Artificial Sequence
  Description of Artificial Sequence: Synthetic oligonucleotide
gggaggacgaugcggucugaagggugauggguccgcagacgacucgcccga

SEQ ID NO: 7630 - RNA, 51 nt, Artificial Sequence
  Description of Artificial Sequence: Synthetic oligonucleotide
gggaggacgaugcggugucguagucuauccgcccgcagacgacucgcccga

SEQ ID NO: 7631 - RNA, 51 nt, Artificial Sequence
  Description of Artificial Sequence: Synthetic oligonucleotide
gggaggacgaugcgguuugaaggguaauggguccgcagacgacucgcccga

SEQ ID NO: 7632 - RNA, 51 nt, Artificial Sequence
  Description of Artificial Sequence: Synthetic oligonucleotide
gggaggacgaugcgguuugaagggugaugggaccgcagacgacucgcccga

SEQ ID NO: 7633 - RNA, 51 nt, Artificial Sequence
  Description of Artificial Sequence: Synthetic oligonucleotide
gggaggacgaugcgguuugaagggugaugggucugcagacgacucgcccga

SEQ ID NO: 7634 - RNA, 51 nt, Artificial Sequence
  Description of Artificial Sequence: Synthetic oligonucleotide
gggaggacgaugcgguuugaagggugaugggcccgcagacgacucgcccga

SEQ ID NO: 7635 - RNA, 51 nt, Artificial Sequence
  Description of Artificial Sequence: Synthetic oligonucleotide
gggaggacgaugcgguuggguguagggagguaccgcagacgacucgcccga

SEQ ID NO: 7636 - RNA, 51 nt, Artificial Sequence
  Description of Artificial Sequence: Synthetic oligonucleotide
gggaggacgaugcggauuggugaagggaggugcugcagacgacucgcccga

SEQ ID NO: 7637 - RNA, 51 nt, Artificial Sequence
  Description of Artificial Sequence: Synthetic oligonucleotide
gggaggacgaugcgguuugaaggaugauggguccgcagacgacucgcccga

SEQ ID NO: 7638 - RNA, 51 nt, Artificial Sequence
  Description of Artificial Sequence: Synthetic oligonucleotide
gggaggacgaugcgguuugaagagugauggguccgcagacgacucgcccga

SEQ ID NO: 7639 - RNA, 51 nt, Artificial Sequence
  Description of Artificial Sequence: Synthetic oligonucleotide
gggaggacgaugcgguuugaagggugauagguccgcagacgacucgcccga

SEQ ID NO: 7640 - RNA, 51 nt, Artificial Sequence
  Description of Artificial Sequence: Synthetic oligonucleotide
gggaggacgaugcggucuugucgucuguucguccccagacgacucgcccga

SEQ ID NO: 7641 - RNA, 50 nt, Artificial Sequence
  Description of Artificial Sequence: Synthetic oligonucleotide
gggaggacgaugcgguccugucgucuguucgucccagacgacucgcccga

SEQ ID NO: 7642 - RNA, 51 nt, Artificial Sequence
  Description of Artificial Sequence: Synthetic oligonucleotide
gggaggacgaugcgguuugaaaggugauggguccgcagacgacucgcccga

SEQ ID NO: 7643 - RNA, 51 nt, Artificial Sequence
  Description of Artificial Sequence: Synthetic oligonucleotide
gggaggacgaugcgguuggguguagggcgguaccgcagacgacucgcccga

SEQ ID NO: 7644 - RNA, 51 nt, Artificial Sequence
  Description of Artificial Sequence: Synthetic oligonucleotide
gggaggacgaugcgguuugaagggugauggauccgcagacgacucgcccga

SEQ ID NO: 7645 - RNA, 52 nt, Artificial Sequence
  Description of Artificial Sequence: Synthetic oligonucleotide
gggaggacgaugcgguuuugaagggugauggguccgcagacgacucgcccga

SEQ ID NO: 7646 - RNA, 51 nt, Artificial Sequence
  Description of Artificial Sequence: Synthetic oligonucleotide
gggaggacgaugcgguuugaagggugacggguccgcagacgacucgcccga

SEQ ID NO: 7647 - RNA, 51 nt, Artificial Sequence
  Description of Artificial Sequence: Synthetic oligonucleotide
gggaggacgaugcgguccugucgucuuugcguccccagacgacucgcccga

SEQ ID NO: 7648 - RNA, 51 nt, Artificial Sequence
  Description of Artificial Sequence: Synthetic oligonucleotide
gggaggacgaugcggauugguguagggugguaccgcagacgacucgcccga

SEQ ID NO: 7649 - RNA, 50 nt, Artificial Sequence
  Description of Artificial Sequence: Synthetic oligonucleotide
gggaggacgaugcggcuauuggugaaggguggugcagacgacucgcccga

SEQ ID NO: 7650 - RNA, 51 nt, Artificial Sequence
  Description of Artificial Sequence: Synthetic oligonucleotide
gggaggacgaugcggacgugguguagggggguguccagacgacucgcccga

SEQ ID NO: 7651 - RNA, 51 nt, Artificial Sequence
  Description of Artificial Sequence: Synthetic oligonucleotide
gggaggacgaugcgguuugaaggguguuggguccgcagacgacucgcccga

SEQ ID NO: 7652 - RNA, 50 nt, Artificial Sequence
  Description of Artificial Sequence: Synthetic oligonucleotide
gggaggacgaugcgguuugaagggugaugguccgcagacgacucgcccga

SEQ ID NO: 7653 - RNA, 51 nt, Artificial Sequence
  Description of Artificial Sequence: Synthetic oligonucleotide
gggaggacgaugcgguuugaauggugauggguccgcagacgacucgcccga

SEQ ID NO: 7654 - RNA, 51 nt, Artificial Sequence
  Description of Artificial Sequence: Synthetic oligonucleotide
gggaggacgaugcggguuggugaagggagguacugcagacgacucgcccga

SEQ ID NO: 7655 - RNA, 51 nt, Artificial Sequence
  Description of Artificial Sequence: Synthetic oligonucleotide
gggaggacgaugcgguuugaagggugauguguccgcagacgacucgcccga

SEQ ID NO: 7656 - RNA, 51 nt, Artificial Sequence
  Description of Artificial Sequence: Synthetic oligonucleotide
gggaggacgaugcggauuacgagcuuguugccucgcagacgacucgcccga

SEQ ID NO: 7657 - RNA, 51 nt, Artificial Sequence
  Description of Artificial Sequence: Synthetic oligonucleotide
gggaggacgaugcgguuuggagggugauggguccgcagacgacucgcccga

SEQ ID NO: 7658 - RNA, 51 nt, Artificial Sequence
  Description of Artificial Sequence: Synthetic oligonucleotide
gggaggacgaugcgguuugaagggugauugguccgcagacgacucgcccga

SEQ ID NO: 7659 - RNA, 51 nt, Artificial Sequence
  Description of Artificial Sequence: Synthetic oligonucleotide
gggaggacgaugcgguuggguguagggggguaccgcagacgacucgcccga

SEQ ID NO: 7660 - RNA, 51 nt, Artificial Sequence
  Description of Artificial Sequence: Synthetic oligonucleotide
gggaggacgaugcgguuugaagggugaugaguccgcagacgacucgcccga

SEQ ID NO: 7661 - RNA, 51 nt, Artificial Sequence
  Description of Artificial Sequence: Synthetic oligonucleotide
gggaggacgaugcgguuugaagggugauggguucgcagacgacucgcccga

SEQ ID NO: 7662 - RNA, 51 nt, Artificial Sequence
  Description of Artificial Sequence: Synthetic oligonucleotide
gggaggacgaugcgguuugaagggugauggguccacagacgacucgcccga

SEQ ID NO: 7663 - RNA, 51 nt, Artificial Sequence
  Description of Artificial Sequence: Synthetic oligonucleotide
gggaggacgaugcggcgauuccucugguucguccccagacgacucgcccga

SEQ ID NO: 7664 - RNA, 51 nt, Artificial Sequence
  Description of Artificial Sequence: Synthetic oligonucleotide
gggaggacgaugcgguuuggugaagggagguacugcagacgacucgcccga

SEQ ID NO: 7665 - RNA, 51 nt, Artificial Sequence
  Description of Artificial Sequence: Synthetic oligonucleotide
gggaggacgaugcggcgacucgaucuguucguccccagacgacucgcccga

SEQ ID NO: 7666 - RNA, 50 nt, Artificial Sequence
  Description of Artificial Sequence: Synthetic oligonucleotide
gggaggacgaugcggauuggugaagggagguugccagacgacucgcccga

SEQ ID NO: 7667 - RNA, 51 nt, Artificial Sequence
  Description of Artificial Sequence: Synthetic oligonucleotide
gggaggacgaugcgguuugaagggugauggcuccgcagacgacucgcccga

SEQ ID NO: 7668 - RNA, 51 nt, Artificial Sequence
  Description of Artificial Sequence: Synthetic oligonucleotide
gggaggacgaugcgguccuggcuugucguuguccccagacgacucgcccga

SEQ ID NO: 7669 - RNA, 50 nt, Artificial Sequence
  Description of Artificial Sequence: Synthetic oligonucleotide
gggaggacgaugcgguuugaagggugaugggucgcagacgacucgcccga

SEQ ID NO: 7670 - RNA, 50 nt, Artificial Sequence
  Description of Artificial Sequence: Synthetic oligonucleotide
gggaggacgaugcgggccuuucguucugccuccccagacgacucgcccga

SEQ ID NO: 7671 - RNA, 51 nt, Artificial Sequence
  Description of Artificial Sequence: Synthetic oligonucleotide
gggaggacgaugcgguucuggcuugucguuguccccagacgacucgcccga

SEQ ID NO: 7672 - RNA, 51 nt, Artificial Sequence
  Description of Artificial Sequence: Synthetic oligonucleotide
gggaggacgaugcggauuggcgaagggagguacugcagacgacucgcccga

SEQ ID NO: 7673 - RNA, 51 nt, Artificial Sequence
  Description of Artificial Sequence: Synthetic oligonucleotide
gggaggacgaugcgguuugaaggguuauggguccgcagacgacucgcccga

SEQ ID NO: 7674 - RNA, 51 nt, Artificial Sequence
  Description of Artificial Sequence: Synthetic oligonucleotide
gggaggacgaugcgguuugaagggugcuggguccgcagacgacucgcccga

SEQ ID NO: 7675 - RNA, 51 nt, Artificial Sequence
  Description of Artificial Sequence: Synthetic oligonucleotide
gggaggacgaugcgguuugaagugugauggguccgcagacgacucgcccga

SEQ ID NO: 7676 - RNA, 51 nt, Artificial Sequence
  Description of Artificial Sequence: Synthetic oligonucleotide
gggaggacgaugcgguugggaguagggugguaccgcagacgacucgcccga

SEQ ID NO: 7677 - RNA, 51 nt, Artificial Sequence
  Description of Artificial Sequence: Synthetic oligonucleotide
gggaggacgaugcgguuugaugggugauggguccgcagacgacucgcccga

SEQ ID NO: 7678 - RNA, 51 nt, Artificial Sequence
  Description of Artificial Sequence: Synthetic oligonucleotide
gggaggacgaugcgguugggcguagggugguaccgcagacgacucgcccga

SEQ ID NO: 7679 - RNA, 51 nt, Artificial Sequence
  Description of Artificial Sequence: Synthetic oligonucleotide
gggaggacgaugcgguuugaagggugaugguuccgcagacgacucgcccga

SEQ ID NO: 7680 - RNA, 51 nt, Artificial Sequence
  Description of Artificial Sequence: Synthetic oligonucleotide
gggaggacgaugcggauuggugaagggggguacugcagacgacucgcccga

SEQ ID NO: 7681 - RNA, 51 nt, Artificial Sequence
  Description of Artificial Sequence: Synthetic oligonucleotide
gggaggacgaugcgggccuuucguucugcccuucccagacgacucgcccga

SEQ ID NO: 7682 - RNA, 51 nt, Artificial Sequence
  Description of Artificial Sequence: Synthetic oligonucleotide
gggaggacgaugcgguuggguguagggagguacugcagacgacucgcccga

SEQ ID NO: 7683 - RNA, 51 nt, Artificial Sequence
  Description of Artificial Sequence: Synthetic oligonucleotide
gggaggacgaugcgguaaaggaguggggagguccgcagacgacucgcccga

SEQ ID NO: 7684 - RNA, 51 nt, Artificial Sequence
  Description of Artificial Sequence: Synthetic oligonucleotide
gggaggacgaugcggauuggugaagggagggacugcagacgacucgcccga

SEQ ID NO: 7685 - RNA, 51 nt, Artificial Sequence
  Description of Artificial Sequence: Synthetic oligonucleotide
gggaggacgaugcgguuugggguuuucccgugccgcagacgacucgcccga

SEQ ID NO: 7686 - RNA, 51 nt, Artificial Sequence
  Description of Artificial Sequence: Synthetic oligonucleotide
gggaggacgaugcgguuaggguguaggguggugcgcagacgacucgcccga

SEQ ID NO: 7687 - RNA, 51 nt, Artificial Sequence
  Description of Artificial Sequence: Synthetic oligonucleotide
gggaggacgaugcgguuggguguagggugguuccgcagacgacucgcccga

SEQ ID NO: 7688 - RNA, 51 nt, Artificial Sequence
  Description of Artificial Sequence: Synthetic oligonucleotide
gggaggacgaugcgggccuuucguucugcucuccccagacgacucgcccga

SEQ ID NO: 7689 - RNA, 51 nt, Artificial Sequence
  Description of Artificial Sequence: Synthetic oligonucleotide
gggaggacgaugcggauugguggagggagguacugcagacgacucgcccga

SEQ ID NO: 7690 - RNA, 51 nt, Artificial Sequence
  Description of Artificial Sequence: Synthetic oligonucleotide
gggaggacgaugcgguuugaagggugaugggucggcagacgacucgcccga

SEQ ID NO: 7691 - RNA, 51 nt, Artificial Sequence
  Description of Artificial Sequence: Synthetic oligonucleotide
gggaggacgaugcggcuaagaggaggugaugggagcagacgacucgcccga

SEQ ID NO: 7692 - RNA, 51 nt, Artificial Sequence
  Description of Artificial Sequence: Synthetic oligonucleotide
gggaggacgaugcgguuuguagggugauggguccgcagacgacucgcccga

SEQ ID NO: 7693 - RNA, 51 nt, Artificial Sequence
  Description of Artificial Sequence: Synthetic oligonucleotide
gggaggacgaugcggauuuuuggagaagggaggugcagacgacucgcccga

SEQ ID NO: 7694 - RNA, 51 nt, Artificial Sequence
  Description of Artificial Sequence: Synthetic oligonucleotide
gggaggacgaugcgguuuaaagggugauggguccgcagacgacucgcccga

SEQ ID NO: 7695 - RNA, 51 nt, Artificial Sequence
  Description of Artificial Sequence: Synthetic oligonucleotide
gggaggacgaugcgguauacggcgguguggggauacagacgacucgcccga

SEQ ID NO: 7696 - RNA, 51 nt, Artificial Sequence
  Description of Artificial Sequence: Synthetic oligonucleotide
gggaggacgaugcgguuugaagggugauggggccgcagacgacucgcccga

SEQ ID NO: 7697 - RNA, 51 nt, Artificial Sequence
  Description of Artificial Sequence: Synthetic oligonucleotide
gggaggacgaugcggauuggugaagggaggcacugcagacgacucgcccga

SEQ ID NO: 7698 - RNA, 51 nt, Artificial Sequence
  Description of Artificial Sequence: Synthetic oligonucleotide
gggaggacgaugcgguguaggaggaggagguacugcagacgacucgcccga

SEQ ID NO: 7699 - RNA, 51 nt, Artificial Sequence
  Description of Artificial Sequence: Synthetic oligonucleotide
gggaggacgaugcggauguauguugggagccacgccagacgacucgcccga

SEQ ID NO: 7700 - RNA, 50 nt, Artificial Sequence
  Description of Artificial Sequence: Synthetic oligonucleotide
gggaggacgaugcgggccuuucguucugcccucccagacgacucgcccga

SEQ ID NO: 7701 - RNA, 51 nt, Artificial Sequence
  Description of Artificial Sequence: Synthetic oligonucleotide
gggaggacgaugcgguauacggugguguggggauacagacgacucgcccga

SEQ ID NO: 7702 - RNA, 51 nt, Artificial Sequence
  Description of Artificial Sequence: Synthetic oligonucleotide
gggaggacgaugcgguuacggaggugaggggcaaccagacgacucgcccga

SEQ ID NO: 7703 - RNA, 51 nt, Artificial Sequence
  Description of Artificial Sequence: Synthetic oligonucleotide
gggaggacgaugcgguuuuaagggugauggguccgcagacgacucgcccga

SEQ ID NO: 7704 - RNA, 51 nt, Artificial Sequence
  Description of Artificial Sequence: Synthetic oligonucleotide
gggaggacgaugcggauuggugaagggugguaccgcagacgacucgcccga

SEQ ID NO: 7705 - RNA, 51 nt, Artificial Sequence
  Description of Artificial Sequence: Synthetic oligonucleotide
gggaggacgaugcgguuugaagguugauggguccgcagacgacucgcccga

SEQ ID NO: 7706 - RNA, 51 nt, Artificial Sequence
  Description of Artificial Sequence: Synthetic oligonucleotide
gggaggacgaugcgguuggggguagggugguaccgcagacgacucgcccga

SEQ ID NO: 7707 - RNA, 51 nt, Artificial Sequence
  Description of Artificial Sequence: Synthetic oligonucleotide
gggaggacgaugcggcuggguguagggugguaccgcagacgacucgcccga

SEQ ID NO: 7708 - RNA, 51 nt, Artificial Sequence
  Description of Artificial Sequence: Synthetic oligonucleotide
gggaggacgaugcgggccuuucguucuacccuccccagacgacucgcccga

SEQ ID NO: 7709 - RNA, 51 nt, Artificial Sequence
  Description of Artificial Sequence: Synthetic oligonucleotide
gggaggacgaugcggauugaagggugauggguccgcagacgacucgcccga

SEQ ID NO: 7710 - RNA, 52 nt, Artificial Sequence
  Description of Artificial Sequence: Synthetic oligonucleotide
gggaggacgaugcgguuugaagggugauggguaccgcagacgacucgcccga

SEQ ID NO: 7711 - RNA, 51 nt, Artificial Sequence
  Description of Artificial Sequence: Synthetic oligonucleotide
gggaggacgaugcgguuugaagggugaugggucagcagacgacucgcccga

SEQ ID NO: 7712 - RNA, 50 nt, Artificial Sequence
  Description of Artificial Sequence: Synthetic oligonucleotide
gggaggacgaugcggauggugaagggagguacugcagacgacucgcccga

SEQ ID NO: 7713 - RNA, 51 nt, Artificial Sequence
  Description of Artificial Sequence: Synthetic oligonucleotide
gggaggacgaugcgggccuuucguucugcccucuccagacgacucgcccga

SEQ ID NO: 7714 - RNA, 51 nt, Artificial Sequence
  Description of Artificial Sequence: Synthetic oligonucleotide
gggaggacgaugcggugagucguucccuucguccccagacgacucgcccga

SEQ ID NO: 7715 - RNA, 51 nt, Artificial Sequence
  Description of Artificial Sequence: Synthetic oligonucleotide
gggaggacgaugcgguuugaagggugaaggguccgcagacgacucgcccga

SEQ ID NO: 7716 - RNA, 51 nt, Artificial Sequence
  Description of Artificial Sequence: Synthetic oligonucleotide
gggaggacgaugcgggacuagcgaucuguuacgcacagacgacucgcccga

SEQ ID NO: 7717 - RNA, 51 nt, Artificial Sequence
  Description of Artificial Sequence: Synthetic oligonucleotide
gggaggacgaugcgguuugcagggugauggguccgcagacgacucgcccga

SEQ ID NO: 7718 - RNA, 51 nt, Artificial Sequence
  Description of Artificial Sequence: Synthetic oligonucleotide
gggaggacgaugcgguuugaagggugauggguacgcagacgacucgcccga

SEQ ID NO: 7719 - RNA, 51 nt, Artificial Sequence
  Description of Artificial Sequence: Synthetic oligonucleotide
gggaggacgaugcgguccugucgucuguucuuccccagacgacucgcccga

SEQ ID NO: 7720 - RNA, 51 nt, Artificial Sequence
  Description of Artificial Sequence: Synthetic oligonucleotide
gggaggacgaugcggauuggaggugguggguuccgcagacgacucgcccga

SEQ ID NO: 7721 - RNA, 51 nt, Artificial Sequence
  Description of Artificial Sequence: Synthetic oligonucleotide
gggaggacgaugcggaucggugaagggagguacugcagacgacucgcccga

SEQ ID NO: 7722 - RNA, 50 nt, Artificial Sequence
  Description of Artificial Sequence: Synthetic oligonucleotide
gggaggacgaugcggucugugugggauguggccccagacgacucgcccga

SEQ ID NO: 7723 - RNA, 51 nt, Artificial Sequence
  Description of Artificial Sequence: Synthetic oligonucleotide
gggaggacgaugcgguuugaagggugauggguccucagacgacucgcccga

SEQ ID NO: 7724 - RNA, 49 nt, Artificial Sequence
  Description of Artificial Sequence: Synthetic oligonucleotide
gggaggacgaugcgggccuuucguugcccuccccagacgacucgcccga

SEQ ID NO: 7725 - RNA, 50 nt, Artificial Sequence
  Description of Artificial Sequence: Synthetic oligonucleotide
gggaggacgaugcgguuugaaggugauggguccgcagacgacucgcccga

SEQ ID NO: 7726 - RNA, 51 nt, Artificial Sequence
  Description of Artificial Sequence: Synthetic oligonucleotide
gggaggacgaugcgguuggguguaggguggcaccgcagacgacucgcccga

SEQ ID NO: 7727 - RNA, 51 nt, Artificial Sequence
  Description of Artificial Sequence: Synthetic oligonucleotide
gggaggacgaugcggguccugucgucuuacguccccagacgacucgcccga

SEQ ID NO: 7728 - RNA, 51 nt, Artificial Sequence
  Description of Artificial Sequence: Synthetic oligonucleotide
gggaggacgaugcggauuggugaggggagguacugcagacgacucgcccga

SEQ ID NO: 7729 - RNA, 51 nt, Artificial Sequence
  Description of Artificial Sequence: Synthetic oligonucleotide
gggaggacgaugcgggccuucguuugguucguccccagacgacucgcccga

SEQ ID NO: 7730 - RNA, 51 nt, Artificial Sequence
  Description of Artificial Sequence: Synthetic oligonucleotide
gggaggacgaugcggauuggugaagggaguuacugcagacgacucgcccga

SEQ ID NO: 7731 - RNA, 51 nt, Artificial Sequence
  Description of Artificial Sequence: Synthetic oligonucleotide
gggaggacgaugcgguuggguguggggugguaccgcagacgacucgcccga

SEQ ID NO: 7732 - RNA, 51 nt, Artificial Sequence
  Description of Artificial Sequence: Synthetic oligonucleotide
gggaggacgaugcggauuggugaagggaggaacugcagacgacucgcccga

SEQ ID NO: 7733 - RNA, 51 nt, Artificial Sequence
  Description of Artificial Sequence: Synthetic oligonucleotide
gggaggacgaugcgguuugguguagggugguaccgcagacgacucgcccga

SEQ ID NO: 7734 - RNA, 51 nt, Artificial Sequence
  Description of Artificial Sequence: Synthetic oligonucleotide
gggaggacgaugcgguuggguguagggugggaccgcagacgacucgcccga

SEQ ID NO: 7735 - RNA, 51 nt, Artificial Sequence
  Description of Artificial Sequence: Synthetic oligonucleotide
gggaggacgaugcggcugucuaccuucuacugccgcagacgacucgcccga

SEQ ID NO: 7736 - RNA, 51 nt, Artificial Sequence
  Description of Artificial Sequence: Synthetic oligonucleotide
gggaggacgaugcgguuugacgggugauggguccgcagacgacucgcccga

SEQ ID NO: 7737 - RNA, 51 nt, Artificial Sequence
  Description of Artificial Sequence: Synthetic oligonucleotide
gggaggacgaugcgggccuuucguucugccucccccagacgacucgcccga

SEQ ID NO: 7738 - RNA, 51 nt, Artificial Sequence
  Description of Artificial Sequence: Synthetic oligonucleotide
gggaggacgaugcggauuggugaagggugguacugcagacgacucgcccga

SEQ ID NO: 7739 - RNA, 50 nt, Artificial Sequence
  Description of Artificial Sequence: Synthetic oligonucleotide
gggaggacgaugcgggccuucguucugaccuccccagacgacucgcccga

SEQ ID NO: 7740 - RNA, 51 nt, Artificial Sequence
  Description of Artificial Sequence: Synthetic oligonucleotide
gggaggacgaugcgguugggugcagggugguaccgcagacgacucgcccga

SEQ ID NO: 7741 - RNA, 51 nt, Artificial Sequence
  Description of Artificial Sequence: Synthetic oligonucleotide
gggaggacgaugcggacuggugaagggagguacugcagacgacucgcccga

SEQ ID NO: 7742 - RNA, 51 nt, Artificial Sequence
  Description of Artificial Sequence: Synthetic oligonucleotide
gggaggacgaugcggugcguuucgucucgcguccccagacgacucgcccga

SEQ ID NO: 7743 - RNA, 51 nt, Artificial Sequence
  Description of Artificial Sequence: Synthetic oligonucleotide
gggaggacgaugcggucuguacagucucccaugugcagacgacucgcccga

SEQ ID NO: 7744 - RNA, 51 nt, Artificial Sequence
  Description of Artificial Sequence: Synthetic oligonucleotide
gggaggacgaugcgggcuuuucguucugcccuccccagacgacucgcccga

SEQ ID NO: 7745 - RNA, 51 nt, Artificial Sequence
  Description of Artificial Sequence: Synthetic oligonucleotide
gggaggacgaugcgguuugaagggugaugggugcgcagacgacucgcccga

SEQ ID NO: 7746 - RNA, 51 nt, Artificial Sequence
  Description of Artificial Sequence: Synthetic oligonucleotide
gggaggacgaugcgggccuuucguucugccuuccccagacgacucgcccga

SEQ ID NO: 7747 - RNA, 51 nt, Artificial Sequence
  Description of Artificial Sequence: Synthetic oligonucleotide
gggaggacgaugcgggccuuucguucuucccuccccagacgacucgcccga

SEQ ID NO: 7748 - RNA, 51 nt, Artificial Sequence
  Description of Artificial Sequence: Synthetic oligonucleotide
gggaggacgaugcgguccuuucguucugcccuccccagacgacucgcccga

SEQ ID NO: 7749 - RNA, 51 nt, Artificial Sequence
  Description of Artificial Sequence: Synthetic oligonucleotide
gggaggacgaugcggucggguguagggugguaccgcagacgacucgcccga

SEQ ID NO: 7750 - RNA, 51 nt, Artificial Sequence
  Description of Artificial Sequence: Synthetic oligonucleotide
gggaggacgaugcgguuggguguagagugguaccgcagacgacucgcccga

SEQ ID NO: 7751 - RNA, 51 nt, Artificial Sequence
  Description of Artificial Sequence: Synthetic oligonucleotide
gggaggacgaugcgguuggauguagggugguaccgcagacgacucgcccga

SEQ ID NO: 7752 - RNA, 51 nt, Artificial Sequence
  Description of Artificial Sequence: Synthetic oligonucleotide
gggaggacgaugcgguuugaagggggaugggaccgcagacgacucgcccga

SEQ ID NO: 7753 - RNA, 51 nt, Artificial Sequence
  Description of Artificial Sequence: Synthetic oligonucleotide
gggaggacgaugcgggccuuucguucuggccuccccagacgacucgcccga

SEQ ID NO: 7754 - RNA, 51 nt, Artificial Sequence
  Description of Artificial Sequence: Synthetic oligonucleotide
gggaggacgaugcggauuggagaagggagguacugcagacgacucgcccga

SEQ ID NO: 7755 - RNA, 51 nt, Artificial Sequence
  Description of Artificial Sequence: Synthetic oligonucleotide
gggaggacgaugcggauuggguguagggaguuccgcagacgacucgcccga

SEQ ID NO: 7756 - RNA, 50 nt, Artificial Sequence
  Description of Artificial Sequence: Synthetic oligonucleotide
gggaggacgaugcgguggguguagggugguaccgcagacgacucgcccga

SEQ ID NO: 7757 - RNA, 51 nt, Artificial Sequence
  Description of Artificial Sequence: Synthetic oligonucleotide
gggaggacgaugcgguauuggagguguaggguccgcagacgacucgcccga

SEQ ID NO: 7758 - RNA, 51 nt, Artificial Sequence
  Description of Artificial Sequence: Synthetic oligonucleotide
gggaggacgaugcgguuggguguaggguaguaccgcagacgacucgcccga

SEQ ID NO: 7759 - RNA, 51 nt, Artificial Sequence
  Description of Artificial Sequence: Synthetic oligonucleotide
gggaggacgaugcgggcauuucguucugaccuccccagacgacucgcccga

SEQ ID NO: 7760 - RNA, 50 nt, Artificial Sequence
  Description of Artificial Sequence: Synthetic oligonucleotide
gggaggacgaugcgggcuuucguucugcccuccccagacgacucgcccga

SEQ ID NO: 7761 - RNA, 50 nt, Artificial Sequence
  Description of Artificial Sequence: Synthetic oligonucleotide
gggaggacgaugcgggccuucguucugcccuccccagacgacucgcccga

SEQ ID NO: 7762 - RNA, 51 nt, Artificial Sequence
  Description of Artificial Sequence: Synthetic oligonucleotide
gggaggacgaugcgguuggguguagugugguaccgcagacgacucgcccga

SEQ ID NO: 7763 - RNA, 51 nt, Artificial Sequence
  Description of Artificial Sequence: Synthetic oligonucleotide
gggaggacgaugcgguaugaagggugauggguccgcagacgacucgcccga

SEQ ID NO: 7764 - RNA, 51 nt, Artificial Sequence
  Description of Artificial Sequence: Synthetic oligonucleotide
gggaggacgaugcggauugguaaagggagguacugcagacgacucgcccga

SEQ ID NO: 7765 - RNA, 51 nt, Artificial Sequence
  Description of Artificial Sequence: Synthetic oligonucleotide
gggaggacgaugcgguuagguguagggugguaccgcagacgacucgcccga

SEQ ID NO: 7766 - RNA, 51 nt, Artificial Sequence
  Description of Artificial Sequence: Synthetic oligonucleotide
gggaggacgaugcgguuggguguaggaugguaccgcagacgacucgcccga

SEQ ID NO: 7767 - RNA, 51 nt, Artificial Sequence
  Description of Artificial Sequence: Synthetic oligonucleotide
gggaggacgaugcgguuggguguagggugguaccccagacgacucgcccga

SEQ ID NO: 7768 - RNA, 51 nt, Artificial Sequence
  Description of Artificial Sequence: Synthetic oligonucleotide
gggaggacgaugcgguuggguguaaggugguaccgcagacgacucgcccga

SEQ ID NO: 7769 - RNA, 51 nt, Artificial Sequence
  Description of Artificial Sequence: Synthetic oligonucleotide
gggaggacgaugcgggcccuucguucugcccuccccagacgacucgcccga

SEQ ID NO: 7770 - RNA, 51 nt, Artificial Sequence
  Description of Artificial Sequence: Synthetic oligonucleotide
gggaggacgaugcgguuugaaggcugauggguccgcagacgacucgcccga

SEQ ID NO: 7771 - RNA, 51 nt, Artificial Sequence
  Description of Artificial Sequence: Synthetic oligonucleotide
gggaggacgaugcgggccuuucguucuguccuccccagacgacucgcccga

SEQ ID NO: 7772 - RNA, 49 nt, Artificial Sequence
  Description of Artificial Sequence: Synthetic oligonucleotide
gggaggacgaugcgguuugaagggugauguccgcagacgacucgcccga

SEQ ID NO: 7773 - RNA, 51 nt, Artificial Sequence
  Description of Artificial Sequence: Synthetic oligonucleotide
gggaggacgaugcggauggguguagggugguaccgcagacgacucgcccga

SEQ ID NO: 7774 - RNA, 51 nt, Artificial Sequence
  Description of Artificial Sequence: Synthetic oligonucleotide
gggaggacgaugcggagucuugucguuuguggcgccagacgacucgcccga

SEQ ID NO: 7775 - RNA, 51 nt, Artificial Sequence
  Description of Artificial Sequence: Synthetic oligonucleotide
gggaggacgaugcgguuugaagggugaugcguccgcagacgacucgcccga

SEQ ID NO: 7776 - RNA, 51 nt, Artificial Sequence
  Description of Artificial Sequence: Synthetic oligonucleotide
gggaggacgaugcggugugaagggugauggguccgcagacgacucgcccga

SEQ ID NO: 7777 - RNA, 50 nt, Artificial Sequence
  Description of Artificial Sequence: Synthetic oligonucleotide
gggaggacgaugcgguuugagggugauggguccgcagacgacucgcccga

SEQ ID NO: 7778 - RNA, 51 nt, Artificial Sequence
  Description of Artificial Sequence: Synthetic oligonucleotide
gggaggacgaugcgguuugaagggucauggguccgcagacgacucgcccga

SEQ ID NO: 7779 - RNA, 51 nt, Artificial Sequence
  Description of Artificial Sequence: Synthetic oligonucleotide
gggaggacgaugcgggccuucuucugguucguccccagacgacucgcccga

SEQ ID NO: 7780 - RNA, 51 nt, Artificial Sequence
  Description of Artificial Sequence: Synthetic oligonucleotide
gggaggacgaugcgguuucaagggugauggguccgcagacgacucgcccga

SEQ ID NO: 7781 - RNA, 51 nt, Artificial Sequence
  Description of Artificial Sequence: Synthetic oligonucleotide
gggaggacgaugcgggccuuucguucugcccuccgcagacgacucgcccga

SEQ ID NO: 7782 - RNA, 50 nt, Artificial Sequence
  Description of Artificial Sequence: Synthetic oligonucleotide
gggaggacgaugcgggccuuucguucugaccucccagacgacucgcccga

SEQ ID NO: 7783 - RNA, 51 nt, Artificial Sequence
  Description of Artificial Sequence: Synthetic oligonucleotide
gggaggacgaugcgguuggguguugggugguaccgcagacgacucgcccga

SEQ ID NO: 7784 - RNA, 50 nt, Artificial Sequence
  Description of Artificial Sequence: Synthetic oligonucleotide
gggaggacgaugcgguugguguagggugguaccgcagacgacucgcccga

SEQ ID NO: 7785 - RNA, 50 nt, Artificial Sequence
  Description of Artificial Sequence: Synthetic oligonucleotide
gggaggacgaugcgguuugaagggugaugggccgcagacgacucgcccga

SEQ ID NO: 7786 - RNA, 51 nt, Artificial Sequence
  Description of Artificial Sequence: Synthetic oligonucleotide
gggaggacgaugcgggccuuucguucuguucuccccagacgacucgcccga

SEQ ID NO: 7787 - RNA, 51 nt, Artificial Sequence
  Description of Artificial Sequence: Synthetic oligonucleotide
gggaggacgaugcggauugguguagggagguacugcagacgacucgcccga

SEQ ID NO: 7788 - RNA, 51 nt, Artificial Sequence
  Description of Artificial Sequence: Synthetic oligonucleotide
gggaggacgaugcgguuggguguagggugguaccacagacgacucgcccga

SEQ ID NO: 7789 - RNA, 51 nt, Artificial Sequence
  Description of Artificial Sequence: Synthetic oligonucleotide
gggaggacgaugcgguuaaggugguguaggggccgcagacgacucgcccga

SEQ ID NO: 7790 - RNA, 51 nt, Artificial Sequence
  Description of Artificial Sequence: Synthetic oligonucleotide
gggaggacgaugcgguugaguguagggugguaccgcagacgacucgcccga

SEQ ID NO: 7791 - RNA, 51 nt, Artificial Sequence
  Description of Artificial Sequence: Synthetic oligonucleotide
gggaggacgaugcgguuggguggagggugguaccgcagacgacucgcccga

SEQ ID NO: 7792 - RNA, 51 nt, Artificial Sequence
  Description of Artificial Sequence: Synthetic oligonucleotide
gggaggacgaugcgggccuuucguucugcccuccucagacgacucgcccga

SEQ ID NO: 7793 - RNA, 50 nt, Artificial Sequence
  Description of Artificial Sequence: Synthetic oligonucleotide
gggaggacgaugcgggccuuucgucugcccuccccagacgacucgcccga

SEQ ID NO: 7794 - RNA, 51 nt, Artificial Sequence
  Description of Artificial Sequence: Synthetic oligonucleotide
gggaggacgaugcgguuggguguauggugguaccgcagacgacucgcccga

SEQ ID NO: 7795 - RNA, 51 nt, Artificial Sequence
  Description of Artificial Sequence: Synthetic oligonucleotide
gggaggacgaugcgggccuuucguucugccccccccagacgacucgcccga

SEQ ID NO: 7796 - RNA, 51 nt, Artificial Sequence
  Description of Artificial Sequence: Synthetic oligonucleotide
gggaggacgaugcgggccuuucguucugaccuccacagacgacucgcccga

SEQ ID NO: 7797 - RNA, 51 nt, Artificial Sequence
  Description of Artificial Sequence: Synthetic oligonucleotide
gggaggacgaugcggauuggugaagggaaguacugcagacgacucgcccga

SEQ ID NO: 7798 - RNA, 51 nt, Artificial Sequence
  Description of Artificial Sequence: Synthetic oligonucleotide
gggaggacgaugcgguugggugaagggagguacugcagacgacucgcccga

SEQ ID NO: 7799 - RNA, 51 nt, Artificial Sequence
  Description of Artificial Sequence: Synthetic oligonucleotide
gggaggacgaugcggauuggggaagggagguacugcagacgacucgcccga

SEQ ID NO: 7800 - RNA, 50 nt, Artificial Sequence
  Description of Artificial Sequence: Synthetic oligonucleotide
gggaggacgaugcggccuuucguucugcccuccccagacgacucgcccga

SEQ ID NO: 7801 - RNA, 51 nt, Artificial Sequence
  Description of Artificial Sequence: Synthetic oligonucleotide
gggaggacgaugcgggcccuucguucugaccuccccagacgacucgcccga

SEQ ID NO: 7802 - RNA, 49 nt, Artificial Sequence
  Description of Artificial Sequence: Synthetic oligonucleotide
gggaggacgaugcggauuggugaagggagguugcagacgacucgcccga

SEQ ID NO: 7803 - RNA, 51 nt, Artificial Sequence
  Description of Artificial Sequence: Synthetic oligonucleotide
gggaggacgaugcgggccuuucguucugcccuccacagacgacucgcccga

SEQ ID NO: 7804 - RNA, 51 nt, Artificial Sequence
  Description of Artificial Sequence: Synthetic oligonucleotide
gggaggacgaugcgggccauucgucuuuucguccccagacgacucgcccga

SEQ ID NO: 7805 - RNA, 51 nt, Artificial Sequence
  Description of Artificial Sequence: Synthetic oligonucleotide
gggaggacgaugcggcugugaggagcagggugguacagacgacucgcccga

SEQ ID NO: 7806 - RNA, 49 nt, Artificial Sequence
  Description of Artificial Sequence: Synthetic oligonucleotide
gggaggacgaugcgguuggguagggugguaccgcagacgacucgcccga

SEQ ID NO: 7807 - RNA, 51 nt, Artificial Sequence
  Description of Artificial Sequence: Synthetic oligonucleotide
gggaggacgaugcgguuggguguagggugauaccgcagacgacucgcccga

SEQ ID NO: 7808 - RNA, 51 nt, Artificial Sequence
  Description of Artificial Sequence: Synthetic oligonucleotide
gggaggacgaugcgguuugaagggugagggguccgcagacgacucgcccga

SEQ ID NO: 7809 - RNA, 51 nt, Artificial Sequence
  Description of Artificial Sequence: Synthetic oligonucleotide
gggaggacgaugcggauuggugaagggagauacugcagacgacucgcccga

SEQ ID NO: 7810 - RNA, 49 nt, Artificial Sequence
  Description of Artificial Sequence: Synthetic oligonucleotide
gggaggacgaugcgguuugaagggugaugggugcagacgacucgcccga

SEQ ID NO: 7811 - RNA, 51 nt, Artificial Sequence
  Description of Artificial Sequence: Synthetic oligonucleotide
gggaggacgaugcgguaggggugugggguguuaugcagacgacucgcccga

SEQ ID NO: 7812 - RNA, 51 nt, Artificial Sequence
  Description of Artificial Sequence: Synthetic oligonucleotide
gggaggacgaugcggauuggugaugggagguacugcagacgacucgcccga

SEQ ID NO: 7813 - RNA, 51 nt, Artificial Sequence
  Description of Artificial Sequence: Synthetic oligonucleotide
gggaggacgaugcggauuggugaaaggagguacugcagacgacucgcccga

SEQ ID NO: 7814 - RNA, 49 nt, Artificial Sequence
  Description of Artificial Sequence: Synthetic oligonucleotide
gggaggacgaugcgguuugaagggugauggguccagacgacucgcccga

SEQ ID NO: 7815 - RNA, 51 nt, Artificial Sequence
  Description of Artificial Sequence: Synthetic oligonucleotide
gggaggacgaugcgggccucucguucugaccuccccagacgacucgcccga

SEQ ID NO: 7816 - RNA, 51 nt, Artificial Sequence
  Description of Artificial Sequence: Synthetic oligonucleotide
gggaggacgaugcggauuggugaagggagcuacugcagacgacucgcccga

SEQ ID NO: 7817 - RNA, 51 nt, Artificial Sequence
  Description of Artificial Sequence: Synthetic oligonucleotide
gggaggacgaugcggauuggugaaggaagguacugcagacgacucgcccga

SEQ ID NO: 7818 - RNA, 51 nt, Artificial Sequence
  Description of Artificial Sequence: Synthetic oligonucleotide
gggaggacgaugcggauugaugaagggagguacugcagacgacucgcccga

SEQ ID NO: 7819 - RNA, 51 nt, Artificial Sequence
  Description of Artificial Sequence: Synthetic oligonucleotide
gggaggacgaugcgguuggguguaggguggaaccgcagacgacucgcccga

SEQ ID NO: 7820 - RNA, 51 nt, Artificial Sequence
  Description of Artificial Sequence: Synthetic oligonucleotide
gggaggacgaugcggcuguuuguaagggagguggucagacgacucgcccga

SEQ ID NO: 7821 - RNA, 51 nt, Artificial Sequence
  Description of Artificial Sequence: Synthetic oligonucleotide
gggaggacgaugcgguuggguguagggugcuaccgcagacgacucgcccga

SEQ ID NO: 7822 - RNA, 51 nt, Artificial Sequence
  Description of Artificial Sequence: Synthetic oligonucleotide
gggaggacgaugcgggccuuucguucugaccuucccagacgacucgcccga

SEQ ID NO: 7823 - RNA, 51 nt, Artificial Sequence
  Description of Artificial Sequence: Synthetic oligonucleotide
gggaggacgaugcggguuggugaagggagguaccgcagacgacucgcccga

SEQ ID NO: 7824 - RNA, 51 nt, Artificial Sequence
  Description of Artificial Sequence: Synthetic oligonucleotide
gggaggacgaugcggauuagugaagggagguacugcagacgacucgcccga

SEQ ID NO: 7825 - RNA, 51 nt, Artificial Sequence
  Description of Artificial Sequence: Synthetic oligonucleotide
gggaggacgaugcgguuggguguaggguuguaccgcagacgacucgcccga

SEQ ID NO: 7826 - RNA, 51 nt, Artificial Sequence
  Description of Artificial Sequence: Synthetic oligonucleotide
gggaggacgaugcggauuggugaagagagguacugcagacgacucgcccga

SEQ ID NO: 7827 - RNA, 51 nt, Artificial Sequence
  Description of Artificial Sequence: Synthetic oligonucleotide
gggaggacgaugcgguugggugaagggugguaccgcagacgacucgcccga

SEQ ID NO: 7828 - RNA, 51 nt, Artificial Sequence
  Description of Artificial Sequence: Synthetic oligonucleotide
gggaggacgaugcgguuggguguagggugguacggcagacgacucgcccga

SEQ ID NO: 7829 - RNA, 51 nt, Artificial Sequence
  Description of Artificial Sequence: Synthetic oligonucleotide
gggaggacgaugcgggccuuucgcucugcccuccccagacgacucgcccga

SEQ ID NO: 7830 - RNA, 51 nt, Artificial Sequence
  Description of Artificial Sequence: Synthetic oligonucleotide
gggaggacgaugcgguugggugaagggagguaccgcagacgacucgcccga

SEQ ID NO: 7831 - RNA, 51 nt, Artificial Sequence
  Description of Artificial Sequence: Synthetic oligonucleotide
gggaggacgaugcggaaugguggaguagggauacgcagacgacucgcccga

SEQ ID NO: 7832 - RNA, 51 nt, Artificial Sequence
  Description of Artificial Sequence: Synthetic oligonucleotide
gggaggacgaugcggugaaggaguggggagguccgcagacgacucgcccga

SEQ ID NO: 7833 - RNA, 51 nt, Artificial Sequence
  Description of Artificial Sequence: Synthetic oligonucleotide
gggaggacgaugcgggccucucguucugcccuccccagacgacucgcccga

SEQ ID NO: 7834 - RNA, 51 nt, Artificial Sequence
  Description of Artificial Sequence: Synthetic oligonucleotide
gggaggacgaugcgguauuggagguguaggggccgcagacgacucgcccga

SEQ ID NO: 7835 - RNA, 51 nt, Artificial Sequence
  Description of Artificial Sequence: Synthetic oligonucleotide
gggaggacgaugcgguuggguauagggugguaccgcagacgacucgcccga

SEQ ID NO: 7836 - RNA, 50 nt, Artificial Sequence
  Description of Artificial Sequence: Synthetic oligonucleotide
gggaggacgaugcgguuuaagggugauggguccgcagacgacucgcccga

SEQ ID NO: 7837 - RNA, 51 nt, Artificial Sequence
  Description of Artificial Sequence: Synthetic oligonucleotide
gggaggacgaugcgguccugucguccguucguccccagacgacucgcccga

SEQ ID NO: 7838 - RNA, 51 nt, Artificial Sequence
  Description of Artificial Sequence: Synthetic oligonucleotide
gggaggacgaugcgggcuuuucguucugaccuccccagacgacucgcccga

SEQ ID NO: 7839 - RNA, 51 nt, Artificial Sequence
  Description of Artificial Sequence: Synthetic oligonucleotide
gggaggacgaugcggauuggugaagugagguacugcagacgacucgcccga

SEQ ID NO: 7840 - RNA, 51 nt, Artificial Sequence
  Description of Artificial Sequence: Synthetic oligonucleotide
gggaggacgaugcgggccuuucguucugcccuuuccagacgacucgcccga

SEQ ID NO: 7841 - RNA, 51 nt, Artificial Sequence
  Description of Artificial Sequence: Synthetic oligonucleotide
gggaggacgaugcgggccuuucguucugccauccccagacgacucgcccga

SEQ ID NO: 7842 - RNA, 51 nt, Artificial Sequence
  Description of Artificial Sequence: Synthetic oligonucleotide
gggaggacgaugcggauuggugaauggagguacugcagacgacucgcccga

SEQ ID NO: 7843 - RNA, 51 nt, Artificial Sequence
  Description of Artificial Sequence: Synthetic oligonucleotide
gggaggacgaugcggauuggugaagggagguucugcagacgacucgcccga

SEQ ID NO: 7844 - RNA, 51 nt, Artificial Sequence
  Description of Artificial Sequence: Synthetic oligonucleotide
gggaggacgaugcggauuggugaagggagggaccgcagacgacucgcccga

SEQ ID NO: 7845 - RNA, 51 nt, Artificial Sequence
  Description of Artificial Sequence: Synthetic oligonucleotide
gggaggacgaugcgguuggaagggugauggguccgcagacgacucgcccga

SEQ ID NO: 7846 - RNA, 51 nt, Artificial Sequence
  Description of Artificial Sequence: Synthetic oligonucleotide
gggaggacgaugcggauugguggagggagguaccgcagacgacucgcccga

SEQ ID NO: 7847 - RNA, 51 nt, Artificial Sequence
  Description of Artificial Sequence: Synthetic oligonucleotide
gggaggacgaugcgguuuggugaagggagguaccgcagacgacucgcccga

SEQ ID NO: 7848 - RNA, 51 nt, Artificial Sequence
  Description of Artificial Sequence: Synthetic oligonucleotide
gggaggacgaugcggauuggugaagggagguacggcagacgacucgcccga

SEQ ID NO: 7849 - RNA, 51 nt, Artificial Sequence
  Description of Artificial Sequence: Synthetic oligonucleotide
gggaggacgaugcgguuugaagggugauaaguccgcagacgacucgcccga

SEQ ID NO: 7850 - RNA, 51 nt, Artificial Sequence
  Description of Artificial Sequence: Synthetic oligonucleotide
gggaggacgaugcgguuugaacggugauggguccgcagacgacucgcccga

SEQ ID NO: 7851 - RNA, 51 nt, Artificial Sequence
  Description of Artificial Sequence: Synthetic oligonucleotide
gggaggacgaugcgggucuuucguucugcccuccccagacgacucgcccga

SEQ ID NO: 7852 - RNA, 51 nt, Artificial Sequence
  Description of Artificial Sequence: Synthetic oligonucleotide
gggaggacgaugcggaccuuucguucugcccuccccagacgacucgcccga

SEQ ID NO: 7853 - RNA, 51 nt, Artificial Sequence
  Description of Artificial Sequence: Synthetic oligonucleotide
gggaggacgaugcggauuggugaagggaggugccgcagacgacucgcccga

SEQ ID NO: 7854 - RNA, 51 nt, Artificial Sequence
  Description of Artificial Sequence: Synthetic oligonucleotide
gggaggacgaugcgguuggguuuagggugguaccgcagacgacucgcccga

SEQ ID NO: 7855 - RNA, 50 nt, Artificial Sequence
  Description of Artificial Sequence: Synthetic oligonucleotide
gggaggacgaugcgguuugaaggggauggguccgcagacgacucgcccga

SEQ ID NO: 7856 - RNA, 51 nt, Artificial Sequence
  Description of Artificial Sequence: Synthetic oligonucleotide
gggaggacgaugcgggccuuucguucugcccucaccagacgacucgcccga

SEQ ID NO: 7857 - RNA, 51 nt, Artificial Sequence
  Description of Artificial Sequence: Synthetic oligonucleotide
gggaggacgaugcgguuugaagcgugauggguccgcagacgacucgcccga

SEQ ID NO: 7858 - RNA, 51 nt, Artificial Sequence
  Description of Artificial Sequence: Synthetic oligonucleotide
gggaggacgaugcgguuugaagggggguggguccgcagacgacucgcccga

SEQ ID NO: 7859 - RNA, 52 nt, Artificial Sequence
  Description of Artificial Sequence: Synthetic oligonucleotide
gggaggacgaugcggcagaggagaagggagguacugcagacgacucgcccga

SEQ ID NO: 7860 - RNA, 51 nt, Artificial Sequence
  Description of Artificial Sequence: Synthetic oligonucleotide
gggaggacgaugcgguugguuguagggugguaccgcagacgacucgcccga

SEQ ID NO: 7861 - RNA, 51 nt, Artificial Sequence
  Description of Artificial Sequence: Synthetic oligonucleotide
gggaggacgaugcggauuggugaagggauguacugcagacgacucgcccga

SEQ ID NO: 7862 - RNA, 51 nt, Artificial Sequence
  Description of Artificial Sequence: Synthetic oligonucleotide
gggaggacgaugcggauuggugaagggagguauugcagacgacucgcccga

SEQ ID NO: 7863 - RNA, 51 nt, Artificial Sequence
  Description of Artificial Sequence: Synthetic oligonucleotide
gggaggacgaugcgguuguguguagggugguaccgcagacgacucgcccga

SEQ ID NO: 7864 - RNA, 51 nt, Artificial Sequence
  Description of Artificial Sequence: Synthetic oligonucleotide
gggaggacgaugcgggccuuucguuuugcccuccccagacgacucgcccga

SEQ ID NO: 7865 - RNA, 50 nt, Artificial Sequence
  Description of Artificial Sequence: Synthetic oligonucleotide
gggaggacgaugcgggccuuucguucugcccccccagacgacucgcccga

SEQ ID NO: 7866 - RNA, 51 nt, Artificial Sequence
  Description of Artificial Sequence: Synthetic oligonucleotide
gggaggacgaugcgggccuuucguucugaucuccccagacgacucgcccga

SEQ ID NO: 7867 - RNA, 51 nt, Artificial Sequence
  Description of Artificial Sequence: Synthetic oligonucleotide
gggaggacgaugcgguuugaagggugaucgguccgcagacgacucgcccga

SEQ ID NO: 7868 - RNA, 51 nt, Artificial Sequence
  Description of Artificial Sequence: Synthetic oligonucleotide
gggaggacgaugcgggccuuucguucugcacuccccagacgacucgcccga

SEQ ID NO: 7869 - RNA, 51 nt, Artificial Sequence
  Description of Artificial Sequence: Synthetic oligonucleotide
gggaggacgaugcggauuggcgaagggagguaccgcagacgacucgcccga

SEQ ID NO: 7870 - RNA, 51 nt, Artificial Sequence
  Description of Artificial Sequence: Synthetic oligonucleotide
gggaggacgaugcggagguguagggggguguaccgcagacgacucgcccga

SEQ ID NO: 7871 - RNA, 51 nt, Artificial Sequence
  Description of Artificial Sequence: Synthetic oligonucleotide
gggaggacgaugcggauuggugaagggagguacuacagacgacucgcccga

SEQ ID NO: 7872 - RNA, 51 nt, Artificial Sequence
  Description of Artificial Sequence: Synthetic oligonucleotide
gggaggacgaugcgguuggguguagguugguaccgcagacgacucgcccga

SEQ ID NO: 7873 - RNA, 51 nt, Artificial Sequence
  Description of Artificial Sequence: Synthetic oligonucleotide
gggaggacgaugcgguuagaagggugauggguccgcagacgacucgcccga

SEQ ID NO: 7874 - RNA, 51 nt, Artificial Sequence
  Description of Artificial Sequence: Synthetic oligonucleotide
gggaggacgaugcggauuggugaagggagguacagcagacgacucgcccga

SEQ ID NO: 7875 - RNA, 49 nt, Artificial Sequence
  Description of Artificial Sequence: Synthetic oligonucleotide
gggaggacgaugcgggccuuucguucuucuccccagacgacucgcccga

SEQ ID NO: 7876 - RNA, 51 nt, Artificial Sequence
  Description of Artificial Sequence: Synthetic oligonucleotide
gggaggacgaugcggguggguguagggugguaccgcagacgacucgcccga

SEQ ID NO: 7877 - RNA, 51 nt, Artificial Sequence
  Description of Artificial Sequence: Synthetic oligonucleotide
gggaggacgaugcgguuggguguagggugguaucgcagacgacucgcccga

SEQ ID NO: 7878 - RNA, 50 nt, Artificial Sequence
  Description of Artificial Sequence: Synthetic oligonucleotide
gggaggacgaugcgggccuuucguuugcccuccccagacgacucgcccga

SEQ ID NO: 7879 - RNA, 51 nt, Artificial Sequence
  Description of Artificial Sequence: Synthetic oligonucleotide
gggaggacgaugcgggccuuucggucugcccuccccagacgacucgcccga

SEQ ID NO: 7880 - RNA, 50 nt, Artificial Sequence
  Description of Artificial Sequence: Synthetic oligonucleotide
gggaggacgaugcgguuggguguaggguguaccgcagacgacucgcccga

SEQ ID NO: 7881 - RNA, 50 nt, Artificial Sequence
  Description of Artificial Sequence: Synthetic oligonucleotide
gggaggacgaugcgggccuuucgucugaccuccccagacgacucgcccga

SEQ ID NO: 7882 - RNA, 51 nt, Artificial Sequence
  Description of Artificial Sequence: Synthetic oligonucleotide
gggaggacgaugcgguguaggaggaggagggaccgcagacgacucgcccga

SEQ ID NO: 7883 - RNA, 51 nt, Artificial Sequence
  Description of Artificial Sequence: Synthetic oligonucleotide
gggaggacgaugcgggccuuucguucugcccugcccagacgacucgcccga

SEQ ID NO: 7884 - RNA, 51 nt, Artificial Sequence
  Description of Artificial Sequence: Synthetic oligonucleotide
gggaggacgaugcggauuggugaagggaggcaccgcagacgacucgcccga

SEQ ID NO: 7885 - RNA, 51 nt, Artificial Sequence
  Description of Artificial Sequence: Synthetic oligonucleotide
gggaggacgaugcgggccuuucguucugcccaccccagacgacucgcccga

SEQ ID NO: 7886 - RNA, 50 nt, Artificial Sequence
  Description of Artificial Sequence: Synthetic oligonucleotide
gggaggacgaugcgggcuuucguucugaccuccccagacgacucgcccga

SEQ ID NO: 7887 - RNA, 51 nt, Artificial Sequence
  Description of Artificial Sequence: Synthetic oligonucleotide
gggaggacgaugcgguguaggaggaggaggugccgcagacgacucgcccga

SEQ ID NO: 7888 - RNA, 51 nt, Artificial Sequence
  Description of Artificial Sequence: Synthetic oligonucleotide
gggaggacgaugcggauugguuaagggagguacugcagacgacucgcccga

SEQ ID NO: 7889 - RNA, 51 nt, Artificial Sequence
  Description of Artificial Sequence: Synthetic oligonucleotide
gggaggacgaugcgggccuuucguucugcccuacccagacgacucgcccga

SEQ ID NO: 7890 - RNA, 51 nt, Artificial Sequence
  Description of Artificial Sequence: Synthetic oligonucleotide
gggaggacgaugcggcuuggugaagggagguacugcagacgacucgcccga

SEQ ID NO: 7891 - RNA, 51 nt, Artificial Sequence
  Description of Artificial Sequence: Synthetic oligonucleotide
gggaggacgaugcggauuggugaagggagguuccgcagacgacucgcccga

SEQ ID NO: 7892 - RNA, 51 nt, Artificial Sequence
  Description of Artificial Sequence: Synthetic oligonucleotide
gggaggacgaugcgguccugucgucugcucguccccagacgacucgcccga

SEQ ID NO: 7893 - RNA, 51 nt, Artificial Sequence
  Description of Artificial Sequence: Synthetic oligonucleotide
gggaggacgaugcggauuggugaagguagguacugcagacgacucgcccga

SEQ ID NO: 7894 - RNA, 51 nt, Artificial Sequence
  Description of Artificial Sequence: Synthetic oligonucleotide
gggaggacgaugcgguuggguguagggugguacagcagacgacucgcccga

SEQ ID NO: 7895 - RNA, 50 nt, Artificial Sequence
  Description of Artificial Sequence: Synthetic oligonucleotide
gggaggacgaugcgguuggguguaggugguaccgcagacgacucgcccga

SEQ ID NO: 7896 - RNA, 51 nt, Artificial Sequence
  Description of Artificial Sequence: Synthetic oligonucleotide
gggaggacgaugcgguugggaguagggugggaccgcagacgacucgcccga

SEQ ID NO: 7897 - RNA, 51 nt, Artificial Sequence
  Description of Artificial Sequence: Synthetic oligonucleotide
gggaggacgaugcgguuggguguaggcugguaccgcagacgacucgcccga

SEQ ID NO: 7898 - RNA, 51 nt, Artificial Sequence
  Description of Artificial Sequence: Synthetic oligonucleotide
gggaggacgaugcgggccuuucguucugcgcuccccagacgacucgcccga

SEQ ID NO: 7899 - RNA, 51 nt, Artificial Sequence
  Description of Artificial Sequence: Synthetic oligonucleotide
gggaggacgaugcgggcauuucguucugcccuccccagacgacucgcccga

SEQ ID NO: 7900 - RNA, 51 nt, Artificial Sequence
  Description of Artificial Sequence: Synthetic oligonucleotide
gggaggacgaugcggauuggugaggggagguaccgcagacgacucgcccga

SEQ ID NO: 7901 - RNA, 50 nt, Artificial Sequence
  Description of Artificial Sequence: Synthetic oligonucleotide
gggaggacgaugcgggccuuucguucugaccccccagacgacucgcccga

SEQ ID NO: 7902 - RNA, 49 nt, Artificial Sequence
  Description of Artificial Sequence: Synthetic oligonucleotide
gggaggacgaugcggugaagggugauggguccgcagacgacucgcccga

SEQ ID NO: 7903 - RNA, 51 nt, Artificial Sequence
  Description of Artificial Sequence: Synthetic oligonucleotide
gggaggacgaugcgggccuuucgaucugcccuccccagacgacucgcccga

SEQ ID NO: 7904 - RNA, 51 nt, Artificial Sequence
  Description of Artificial Sequence: Synthetic oligonucleotide
gggaggacgaugcggcccugucgucuguucguccccagacgacucgcccga

SEQ ID NO: 7905 - RNA, 51 nt, Artificial Sequence
  Description of Artificial Sequence: Synthetic oligonucleotide
gggaggacgaugcggguagguggaguagggguccgcagacgacucgcccga

SEQ ID NO: 7906 - RNA, 51 nt, Artificial Sequence
  Description of Artificial Sequence: Synthetic oligonucleotide
gggaggacgaugcggauuggugaagggagguacuucagacgacucgcccga

SEQ ID NO: 7907 - RNA, 51 nt, Artificial Sequence
  Description of Artificial Sequence: Synthetic oligonucleotide
gggaggacgaugcgggccuuuuguucugcccuccccagacgacucgcccga

SEQ ID NO: 7908 - RNA, 52 nt, Artificial Sequence
  Description of Artificial Sequence: Synthetic oligonucleotide
gggaggacgaugcgggccuuuucguucugcccuccccagacgacucgcccga

SEQ ID NO: 7909 - RNA, 51 nt, Artificial Sequence
  Description of Artificial Sequence: Synthetic oligonucleotide
gggaggacgaugcgguuuggagggggauggguccgcagacgacucgcccga

SEQ ID NO: 7910 - RNA, 51 nt, Artificial Sequence
  Description of Artificial Sequence: Synthetic oligonucleotide
gggaggacgaugcgguuugaagggugaugguaccgcagacgacucgcccga

SEQ ID NO: 7911 - RNA, 51 nt, Artificial Sequence
  Description of Artificial Sequence: Synthetic oligonucleotide
gggaggacgaugcgggccuuucguccugcccuccccagacgacucgcccga

SEQ ID NO: 7912 - RNA, 51 nt, Artificial Sequence
  Description of Artificial Sequence: Synthetic oligonucleotide
gggaggacgaugcgggccuuucauucugcccuccccagacgacucgcccga

SEQ ID NO: 7913 - RNA, 51 nt, Artificial Sequence
  Description of Artificial Sequence: Synthetic oligonucleotide
gggaggacgaugcgggccuuucguucugacuuccccagacgacucgcccga

SEQ ID NO: 7914 - RNA, 52 nt, Artificial Sequence
  Description of Artificial Sequence: Synthetic oligonucleotide
gggaggacgaugcgguuugaaggggugauggguccgcagacgacucgcccga

SEQ ID NO: 7915 - RNA, 51 nt, Artificial Sequence
  Description of Artificial Sequence: Synthetic oligonucleotide
gggaggacgaugcgggccuuucguucuccccuccccagacgacucgcccga

SEQ ID NO: 7916 - RNA, 51 nt, Artificial Sequence
  Description of Artificial Sequence: Synthetic oligonucleotide
gggaggacgaugcgguugggucuagggugguaccgcagacgacucgcccga

SEQ ID NO: 7917 - RNA, 51 nt, Artificial Sequence
  Description of Artificial Sequence: Synthetic oligonucleotide
gggaggacgaugcgggccuuucgcucugaccuccccagacgacucgcccga

SEQ ID NO: 7918 - RNA, 51 nt, Artificial Sequence
  Description of Artificial Sequence: Synthetic oligonucleotide
gggaggacgaugcgggccuuucguucuaaccuccccagacgacucgcccga

SEQ ID NO: 7919 - RNA, 50 nt, Artificial Sequence
  Description of Artificial Sequence: Synthetic oligonucleotide
gggaggacgaugcgggccuuucguucugacuccccagacgacucgcccga

SEQ ID NO: 7920 - RNA, 51 nt, Artificial Sequence
  Description of Artificial Sequence: Synthetic oligonucleotide
gggaggacgaugcgguuggcuguagggugguaccgcagacgacucgcccga

SEQ ID NO: 7921 - RNA, 51 nt, Artificial Sequence
  Description of Artificial Sequence: Synthetic oligonucleotide
gggaggacgaugcggauuggugaagggggguaccgcagacgacucgcccga

SEQ ID NO: 7922 - RNA, 50 nt, Artificial Sequence
  Description of Artificial Sequence: Synthetic oligonucleotide
gggaggacgaugcgggccuuucguucucccuccccagacgacucgcccga

SEQ ID NO: 7923 - RNA, 51 nt, Artificial Sequence
  Description of Artificial Sequence: Synthetic oligonucleotide
gggaggacgaugcgggccuuucguccugaccuccccagacgacucgcccga

SEQ ID NO: 7924 - RNA, 51 nt, Artificial Sequence
  Description of Artificial Sequence: Synthetic oligonucleotide
gggaggacgaugcgguauuggagguguagguaccgcagacgacucgcccga

SEQ ID NO: 7925 - RNA, 51 nt, Artificial Sequence
  Description of Artificial Sequence: Synthetic oligonucleotide
gggaggacgaugcgguccugucgucucuucguccccagacgacucgcccga

SEQ ID NO: 7926 - RNA, 51 nt, Artificial Sequence
  Description of Artificial Sequence: Synthetic oligonucleotide
gggaggacgaugcgguuggguguaggguguugccgcagacgacucgcccga

SEQ ID NO: 7927 - RNA, 51 nt, Artificial Sequence
  Description of Artificial Sequence: Synthetic oligonucleotide
gggaggacgaugcgguggugugucaagguacgcgccagacgacucgcccga

SEQ ID NO: 7928 - RNA, 51 nt, Artificial Sequence
  Description of Artificial Sequence: Synthetic oligonucleotide
gggaggacgaugcggaugggugaagggagguacugcagacgacucgcccga

SEQ ID NO: 7929 - RNA, 50 nt, Artificial Sequence
  Description of Artificial Sequence: Synthetic oligonucleotide
gggaggacgaugcgguccugucgucuguuguccccagacgacucgcccga

SEQ ID NO: 7930 - RNA, 50 nt, Artificial Sequence
  Description of Artificial Sequence: Synthetic oligonucleotide
gggaggacgaugcgguuugaagggugaugggucccagacgacucgcccga

SEQ ID NO: 7931 - RNA, 51 nt, Artificial Sequence
  Description of Artificial Sequence: Synthetic oligonucleotide
gggaggacgaugcggugggguguagggugguaccgcagacgacucgcccga

SEQ ID NO: 7932 - RNA, 51 nt, Artificial Sequence
  Description of Artificial Sequence: Synthetic oligonucleotide
gggaggacgaugcgguuuggagggggaugggaccgcagacgacucgcccga

SEQ ID NO: 7933 - RNA, 51 nt, Artificial Sequence
  Description of Artificial Sequence: Synthetic oligonucleotide
gggaggacgaugcgggccuuucguucagcccuccccagacgacucgcccga

SEQ ID NO: 7934 - RNA, 51 nt, Artificial Sequence
  Description of Artificial Sequence: Synthetic oligonucleotide
gggaggacgaugcgguuggguguagggugguaccucagacgacucgcccga

SEQ ID NO: 7935 - RNA, 51 nt, Artificial Sequence
  Description of Artificial Sequence: Synthetic oligonucleotide
gggaggacgaugcgguuugaagggugauggguuugcagacgacucgcccga

SEQ ID NO: 7936 - RNA, 51 nt, Artificial Sequence
  Description of Artificial Sequence: Synthetic oligonucleotide
gggaggacgaugcggaccuuucguucugaccuccccagacgacucgcccga

SEQ ID NO: 7937 - RNA, 51 nt, Artificial Sequence
  Description of Artificial Sequence: Synthetic oligonucleotide
gggaggacgaugcgggccuuucguucugaccuccgcagacgacucgcccga

SEQ ID NO: 7938 - RNA, 51 nt, Artificial Sequence
  Description of Artificial Sequence: Synthetic oligonucleotide
gggaggacgaugcgguccuguugucuguucguccccagacgacucgcccga

SEQ ID NO: 7939 - RNA, 51 nt, Artificial Sequence
  Description of Artificial Sequence: Synthetic oligonucleotide
gggaggacgaugcgggccuuucguucugaccucaccagacgacucgcccga

SEQ ID NO: 7940 - RNA, 51 nt, Artificial Sequence
  Description of Artificial Sequence: Synthetic oligonucleotide
gggaggacgaugcgggccuuucguuccgcccuccccagacgacucgcccga

SEQ ID NO: 7941 - RNA, 51 nt, Artificial Sequence
  Description of Artificial Sequence: Synthetic oligonucleotide
gggaggacgaugcgggccuuucuuucugcccuccccagacgacucgcccga

SEQ ID NO: 7942 - RNA, 51 nt, Artificial Sequence
  Description of Artificial Sequence: Synthetic oligonucleotide
gggaggacgaugcgggccuuucguucugacucccccagacgacucgcccga

SEQ ID NO: 7943 - RNA, 51 nt, Artificial Sequence
  Description of Artificial Sequence: Synthetic oligonucleotide
gggaggacgaugcggauaggugaagggagguacugcagacgacucgcccga

SEQ ID NO: 7944 - RNA, 51 nt, Artificial Sequence
  Description of Artificial Sequence: Synthetic oligonucleotide
gggaggacgaugcggauuggugaagggcgguacugcagacgacucgcccga

SEQ ID NO: 7945 - RNA, 51 nt, Artificial Sequence
  Description of Artificial Sequence: Synthetic oligonucleotide
gggaggacgaugcgguuggguguaggguggucccgcagacgacucgcccga

SEQ ID NO: 7946 - RNA, 51 nt, Artificial Sequence
  Description of Artificial Sequence: Synthetic oligonucleotide
gggaggacgaugcgggccuuucguuaugcccuccccagacgacucgcccga

SEQ ID NO: 7947 - RNA, 51 nt, Artificial Sequence
  Description of Artificial Sequence: Synthetic oligonucleotide
gggaggacgaugcggauuugugaagggagguacugcagacgacucgcccga

SEQ ID NO: 7948 - RNA, 51 nt, Artificial Sequence
  Description of Artificial Sequence: Synthetic oligonucleotide
gggaggacgaugcggaucuuacacugcagauaccccagacgacucgcccga

SEQ ID NO: 7949 - RNA, 51 nt, Artificial Sequence
  Description of Artificial Sequence: Synthetic oligonucleotide
gggaggacgaugcggauuguugaagggagguacugcagacgacucgcccga

SEQ ID NO: 7950 - RNA, 51 nt, Artificial Sequence
  Description of Artificial Sequence: Synthetic oligonucleotide
gggaggacgaugcgguuugaaggggggugggaccgcagacgacucgcccga

SEQ ID NO: 7951 - RNA, 51 nt, Artificial Sequence
  Description of Artificial Sequence: Synthetic oligonucleotide
gggaggacgaugcgggccuuccguucugcccuccccagacgacucgcccga

SEQ ID NO: 7952 - RNA, 51 nt, Artificial Sequence
  Description of Artificial Sequence: Synthetic oligonucleotide
gggaggacgaugcgguccuuucguucugaccuccccagacgacucgcccga

SEQ ID NO: 7953 - RNA, 49 nt, Artificial Sequence
  Description of Artificial Sequence: Synthetic oligonucleotide
gggaggacgaugcgggccuuucguucuccuccccagacgacucgcccga

SEQ ID NO: 7954 - RNA, 51 nt, Artificial Sequence
  Description of Artificial Sequence: Synthetic oligonucleotide
gggaggacgaugcgguugggaggagggugggaccgcagacgacucgcccga

SEQ ID NO: 7955 - RNA, 51 nt, Artificial Sequence
  Description of Artificial Sequence: Synthetic oligonucleotide
gggaggacgaugcggcgugguggugaagggguacgcagacgacucgcccga

SEQ ID NO: 7956 - RNA, 50 nt, Artificial Sequence
  Description of Artificial Sequence: Synthetic oligonucleotide
gggaggacgaugcggauugugaagggagguacugcagacgacucgcccga

SEQ ID NO: 7957 - RNA, 51 nt, Artificial Sequence
  Description of Artificial Sequence: Synthetic oligonucleotide
gggaggacgaugcggcuugaagggggauggguccgcagacgacucgcccga

SEQ ID NO: 7958 - RNA, 51 nt, Artificial Sequence
  Description of Artificial Sequence: Synthetic oligonucleotide
gggaggacgaugcggauuggugaagggaggaaccgcagacgacucgcccga

SEQ ID NO: 7959 - RNA, 52 nt, Artificial Sequence
  Description of Artificial Sequence: Synthetic oligonucleotide
gggaggacgaugcgguuugaagggugauuggguccgcagacgacucgcccga

SEQ ID NO: 7960 - RNA, 51 nt, Artificial Sequence
  Description of Artificial Sequence: Synthetic oligonucleotide
gggaggacgaugcgggccuuucguucugacccccccagacgacucgcccga

SEQ ID NO: 7961 - RNA, 51 nt, Artificial Sequence
  Description of Artificial Sequence: Synthetic oligonucleotide
gggaggacgaugcgggccauucguucugcccuccccagacgacucgcccga

SEQ ID NO: 7962 - RNA, 52 nt, Artificial Sequence
  Description of Artificial Sequence: Synthetic oligonucleotide
gggaggacgaugcgguuuugaagggugauggguccucagacgacucgcccga

SEQ ID NO: 7963 - RNA, 51 nt, Artificial Sequence
  Description of Artificial Sequence: Synthetic oligonucleotide
gggaggacgaugcgggccuuucguucugacauccccagacgacucgcccga

SEQ ID NO: 7964 - RNA, 51 nt, Artificial Sequence
  Description of Artificial Sequence: Synthetic oligonucleotide
gggaggacgaugcgguaagguggugaugggauucgcagacgacucgcccga

SEQ ID NO: 7965 - RNA, 51 nt, Artificial Sequence
  Description of Artificial Sequence: Synthetic oligonucleotide
gggaggacgaugcggaguuggagaaggguggucugcagacgacucgcccga

SEQ ID NO: 7966 - RNA, 51 nt, Artificial Sequence
  Description of Artificial Sequence: Synthetic oligonucleotide
gggaggacgaugcgguuuggaggagggugggaccgcagacgacucgcccga

SEQ ID NO: 7967 - RNA, 50 nt, Artificial Sequence
  Description of Artificial Sequence: Synthetic oligonucleotide
gggaggacgaugcgguccuucgucuguucguccccagacgacucgcccga

SEQ ID NO: 7968 - RNA, 51 nt, Artificial Sequence
  Description of Artificial Sequence: Synthetic oligonucleotide
gggaggacgaugcggaauggugaagggagguacugcagacgacucgcccga

SEQ ID NO: 7969 - RNA, 51 nt, Artificial Sequence
  Description of Artificial Sequence: Synthetic oligonucleotide
gggaggacgaugcgggccuuucguucugcccucgccagacgacucgcccga

SEQ ID NO: 7970 - RNA, 51 nt, Artificial Sequence
  Description of Artificial Sequence: Synthetic oligonucleotide
gggaggacgaugcgguguaggaggaggaggcaccgcagacgacucgcccga

SEQ ID NO: 7971 - RNA, 50 nt, Artificial Sequence
  Description of Artificial Sequence: Synthetic oligonucleotide
gggaggacgaugcggauuggugaagggaguacugcagacgacucgcccga

SEQ ID NO: 7972 - RNA, 50 nt, Artificial Sequence
  Description of Artificial Sequence: Synthetic oligonucleotide
gggaggacgaugcgguuggguguagggugguccgcagacgacucgcccga

SEQ ID NO: 7973 - RNA, 51 nt, Artificial Sequence
  Description of Artificial Sequence: Synthetic oligonucleotide
gggaggacgaugcggccucauguuuggcuuucguccagacgacucgcccga

SEQ ID NO: 7974 - RNA, 51 nt, Artificial Sequence
  Description of Artificial Sequence: Synthetic oligonucleotide
gggaggacgaugcgggacuuucguucugaccuccccagacgacucgcccga

SEQ ID NO: 7975 - RNA, 50 nt, Artificial Sequence
  Description of Artificial Sequence: Synthetic oligonucleotide
gggaggacgaugcgguugggguagggugguaccgcagacgacucgcccga

SEQ ID NO: 7976 - RNA, 50 nt, Artificial Sequence
  Description of Artificial Sequence: Synthetic oligonucleotide
gggaggacgaugcgguuugggguuuucccgugcccagacgacucgcccga

SEQ ID NO: 7977 - RNA, 51 nt, Artificial Sequence
  Description of Artificial Sequence: Synthetic oligonucleotide
gggaggacgaugcgggccuuuaguucugcccuccccagacgacucgcccga

SEQ ID NO: 7978 - RNA, 51 nt, Artificial Sequence
  Description of Artificial Sequence: Synthetic oligonucleotide
gggaggacgaugcggauuggagaagggagggacugcagacgacucgcccga

SEQ ID NO: 7979 - RNA, 52 nt, Artificial Sequence
  Description of Artificial Sequence: Synthetic oligonucleotide
gggaggacgaugcgguguugaagggugauggguccgcagacgacucgcccga

SEQ ID NO: 7980 - RNA, 51 nt, Artificial Sequence
  Description of Artificial Sequence: Synthetic oligonucleotide
gggaggacgaugcgggccuuucguucugaccucuccagacgacucgcccga

SEQ ID NO: 7981 - RNA, 51 nt, Artificial Sequence
  Description of Artificial Sequence: Synthetic oligonucleotide
gggaggacgaugcgggccuaucguucugcccuccccagacgacucgcccga

SEQ ID NO: 7982 - RNA, 52 nt, Artificial Sequence
  Description of Artificial Sequence: Synthetic oligonucleotide
gggaggacgaugcgguuugaagggugaugggguccgcagacgacucgcccga

SEQ ID NO: 7983 - RNA, 51 nt, Artificial Sequence
  Description of Artificial Sequence: Synthetic oligonucleotide
gggaggacgaugcggcgacuccucuguucccuccccagacgacucgcccga

SEQ ID NO: 7984 - RNA, 51 nt, Artificial Sequence
  Description of Artificial Sequence: Synthetic oligonucleotide
gggaggacgaugcgggccuuucguucugaccuccucagacgacucgcccga

SEQ ID NO: 7985 - RNA, 52 nt, Artificial Sequence
  Description of Artificial Sequence: Synthetic oligonucleotide
gggaggacgaugcgguuuggguguagggugguaccgcagacgacucgcccga

SEQ ID NO: 7986 - RNA, 51 nt, Artificial Sequence
  Description of Artificial Sequence: Synthetic oligonucleotide
gggaggacgaugcgguguaggaggaggugguaccgcagacgacucgcccga

SEQ ID NO: 7987 - RNA, 51 nt, Artificial Sequence
  Description of Artificial Sequence: Synthetic oligonucleotide
gggaggacgaugcgguaggguguagggugguaccgcagacgacucgcccga

SEQ ID NO: 7988 - RNA, 51 nt, Artificial Sequence
  Description of Artificial Sequence: Synthetic oligonucleotide
gggaggacgaugcgguuggguggagggugggaccgcagacgacucgcccga

SEQ ID NO: 7989 - RNA, 51 nt, Artificial Sequence
  Description of Artificial Sequence: Synthetic oligonucleotide
gggaggacgaugcgggccuuucguuccgaccuccccagacgacucgcccga

SEQ ID NO: 7990 - RNA, 51 nt, Artificial Sequence
  Description of Artificial Sequence: Synthetic oligonucleotide
gggaggacgaugcggauugguguagggugguacugcagacgacucgcccga

SEQ ID NO: 7991 - RNA, 50 nt, Artificial Sequence
  Description of Artificial Sequence: Synthetic oligonucleotide
gggaggacgaugcggccuuucguucugaccuccccagacgacucgcccga

SEQ ID NO: 7992 - RNA, 50 nt, Artificial Sequence
  Description of Artificial Sequence: Synthetic oligonucleotide
gggaggacgaugcggauggugaagggagguaccgcagacgacucgcccga

SEQ ID NO: 7993 - RNA, 51 nt, Artificial Sequence
  Description of Artificial Sequence: Synthetic oligonucleotide
gggaggacgaugcgggccuuucguucugccguccccagacgacucgcccga

SEQ ID NO: 7994 - RNA, 51 nt, Artificial Sequence
  Description of Artificial Sequence: Synthetic oligonucleotide
gggaggacgaugcggucccgucgucuguucguccccagacgacucgcccga

SEQ ID NO: 7995 - RNA, 50 nt, Artificial Sequence
  Description of Artificial Sequence: Synthetic oligonucleotide
gggaggacgaugcggauugguaagggagguacugcagacgacucgcccga

SEQ ID NO: 7996 - RNA, 50 nt, Artificial Sequence
  Description of Artificial Sequence: Synthetic oligonucleotide
gggaggacgaugcgggacuguauggggcucugugcagacgacucgcccga

SEQ ID NO: 7997 - RNA, 51 nt, Artificial Sequence
  Description of Artificial Sequence: Synthetic oligonucleotide
gggaggacgaugcgggcguuuccucuguucguccccagacgacucgcccga

SEQ ID NO: 7998 - RNA, 50 nt, Artificial Sequence
  Description of Artificial Sequence: Synthetic oligonucleotide
gggaggacgaugcgguuugaagggugauggguugcagacgacucgcccga

SEQ ID NO: 7999 - RNA, 50 nt, Artificial Sequence
  Description of Artificial Sequence: Synthetic oligonucleotide
gggaggacgaugcggauuggugaagggagguccgcagacgacucgcccga

SEQ ID NO: 8000 - RNA, 51 nt, Artificial Sequence
  Description of Artificial Sequence: Synthetic oligonucleotide
gggaggacgaugcgguccugucgucuguucguucccagacgacucgcccga

SEQ ID NO: 8001 - RNA, 51 nt, Artificial Sequence
  Description of Artificial Sequence: Synthetic oligonucleotide
gggaggacgaugcgguuugaagggcgguggguccgcagacgacucgcccga

SEQ ID NO: 8002 - RNA, 51 nt, Artificial Sequence
  Description of Artificial Sequence: Synthetic oligonucleotide
gggaggacgaugcgguuugaagggagguggguccgcagacgacucgcccga

SEQ ID NO: 8003 - RNA, 49 nt, Artificial Sequence
  Description of Artificial Sequence: Synthetic oligonucleotide
gggaggacgaugcggcaggagaagggagguugccagacgacucgcccga

SEQ ID NO: 8004 - RNA, 51 nt, Artificial Sequence
  Description of Artificial Sequence: Synthetic oligonucleotide
gggaggacgaugcggauuggugcagggagguacugcagacgacucgcccga

SEQ ID NO: 8005 - RNA, 51 nt, Artificial Sequence
  Description of Artificial Sequence: Synthetic oligonucleotide
gggaggacgaugcgguguaggaggaggggguaccgcagacgacucgcccga

SEQ ID NO: 8006 - RNA, 51 nt, Artificial Sequence
  Description of Artificial Sequence: Synthetic oligonucleotide
gggaggacgaugcggcagaggagaagggaggaugccagacgacucgcccga

SEQ ID NO: 8007 - RNA, 51 nt, Artificial Sequence
  Description of Artificial Sequence: Synthetic oligonucleotide
gggaggacgaugcggaucggugaagggagguaccgcagacgacucgcccga

SEQ ID NO: 8008 - RNA, 50 nt, Artificial Sequence
  Description of Artificial Sequence: Synthetic oligonucleotide
gggaggacgaugcgguuugggguuucccgugccccagacgacucgcccga

SEQ ID NO: 8009 - RNA, 51 nt, Artificial Sequence
  Description of Artificial Sequence: Synthetic oligonucleotide
gggaggacgaugcgguugggugucgggugguaccgcagacgacucgcccga

SEQ ID NO: 8010 - RNA, 51 nt, Artificial Sequence
  Description of Artificial Sequence: Synthetic oligonucleotide
gggaggacgaugcgggccuuucauucugaccuccccagacgacucgcccga

SEQ ID NO: 8011 - RNA, 52 nt, Artificial Sequence
  Description of Artificial Sequence: Synthetic oligonucleotide
gggaggacgaugcgguuaggguguagggugguaccgcagacgacucgcccga

SEQ ID NO: 8012 - RNA, 50 nt, Artificial Sequence
  Description of Artificial Sequence: Synthetic oligonucleotide
gggaggacgaugcgguuugaaggguggugguccgcagacgacucgcccga

SEQ ID NO: 8013 - RNA, 51 nt, Artificial Sequence
  Description of Artificial Sequence: Synthetic oligonucleotide
gggaggacgaugcggcccuuucguucugaccuccccagacgacucgcccga

SEQ ID NO: 8014 - RNA, 51 nt, Artificial Sequence
  Description of Artificial Sequence: Synthetic oligonucleotide
gggaggacgaugcggcgaugcuuacgugcacgcgccagacgacucgcccga

SEQ ID NO: 8015 - RNA, 51 nt, Artificial Sequence
  Description of Artificial Sequence: Synthetic oligonucleotide
gggaggacgaugcggcagaggagaagggagggugccagacgacucgcccga

SEQ ID NO: 8016 - RNA, 51 nt, Artificial Sequence
  Description of Artificial Sequence: Synthetic oligonucleotide
gggaggacgaugcggauuggugaagggagguacuccagacgacucgcccga

SEQ ID NO: 8017 - RNA, 51 nt, Artificial Sequence
  Description of Artificial Sequence: Synthetic oligonucleotide
gggaggacgaugcggauugguguagggagguaccgcagacgacucgcccga

SEQ ID NO: 8018 - RNA, 51 nt, Artificial Sequence
  Description of Artificial Sequence: Synthetic oligonucleotide
gggaggacgaugcggauuggagaagggagguaccgcagacgacucgcccga

SEQ ID NO: 8019 - RNA, 51 nt, Artificial Sequence
  Description of Artificial Sequence: Synthetic oligonucleotide
gggaggacgaugcgguugggaggagggugguaccgcagacgacucgcccga

SEQ ID NO: 8020 - RNA, 51 nt, Artificial Sequence
  Description of Artificial Sequence: Synthetic oligonucleotide
gggaggacgaugcggauccuggucgucuuacacugcagacgacucgcccga

SEQ ID NO: 8021 - RNA, 51 nt, Artificial Sequence
  Description of Artificial Sequence: Synthetic oligonucleotide
gggaggacgaugcgggccuuuuguucugaccuccccagacgacucgcccga

SEQ ID NO: 8022 - RNA, 51 nt, Artificial Sequence
  Description of Artificial Sequence: Synthetic oligonucleotide
gggaggacgaugcgguuuggaggggggugggaccgcagacgacucgcccga

SEQ ID NO: 8023 - RNA, 51 nt, Artificial Sequence
  Description of Artificial Sequence: Synthetic oligonucleotide
gggaggacgaugcgggccuuucguucugaccuacccagacgacucgcccga

SEQ ID NO: 8024 - RNA, 51 nt, Artificial Sequence
  Description of Artificial Sequence: Synthetic oligonucleotide
gggaggacgaugcgggccuuccguucugaccuccccagacgacucgcccga

SEQ ID NO: 8025 - RNA, 51 nt, Artificial Sequence
  Description of Artificial Sequence: Synthetic oligonucleotide
gggaggacgaugcgguuugaaggguggugggaccgcagacgacucgcccga

SEQ ID NO: 8026 - RNA, 51 nt, Artificial Sequence
  Description of Artificial Sequence: Synthetic oligonucleotide
gggaggacgaugcggauagggagaaggguggaccgcagacgacucgcccga

SEQ ID NO: 8027 - RNA, 51 nt, Artificial Sequence
  Description of Artificial Sequence: Synthetic oligonucleotide
gggaggacgaugcgggacuuucguucugcccuccccagacgacucgcccga

SEQ ID NO: 8028 - RNA, 51 nt, Artificial Sequence
  Description of Artificial Sequence: Synthetic oligonucleotide
gggaggacgaugcggcagaggagaagggggguugccagacgacucgcccga

SEQ ID NO: 8029 - RNA, 49 nt, Artificial Sequence
  Description of Artificial Sequence: Synthetic oligonucleotide
gggaggacgaugcgggccuuucguucugcccuccagacgacucgcccga

SEQ ID NO: 8030 - RNA, 50 nt, Artificial Sequence
  Description of Artificial Sequence: Synthetic oligonucleotide
gggaggacgaugcgguccugugucuguucguccccagacgacucgcccga

SEQ ID NO: 8031 - RNA, 51 nt, Artificial Sequence
  Description of Artificial Sequence: Synthetic oligonucleotide
gggaggacgaugcgguauuggaggcguagggaccgcagacgacucgcccga

SEQ ID NO: 8032 - RNA, 51 nt, Artificial Sequence
  Description of Artificial Sequence: Synthetic oligonucleotide
gggaggacgaugcgggucuuucguucugaccuccccagacgacucgcccga

SEQ ID NO: 8033 - RNA, 51 nt, Artificial Sequence
  Description of Artificial Sequence: Synthetic oligonucleotide
gggaggacgaugcgguguaggaggaggaggaaccgcagacgacucgcccga

SEQ ID NO: 8034 - RNA, 51 nt, Artificial Sequence
  Description of Artificial Sequence: Synthetic oligonucleotide
gggaggacgaugcgggccuuucgaucugaccuccccagacgacucgcccga

SEQ ID NO: 8035 - RNA, 51 nt, Artificial Sequence
  Description of Artificial Sequence: Synthetic oligonucleotide
gggaggacgaugcgguguaggagggggagguaccgcagacgacucgcccga

SEQ ID NO: 8036 - RNA, 51 nt, Artificial Sequence
  Description of Artificial Sequence: Synthetic oligonucleotide
gggaggacgaugcggcaguggagaagggagguugccagacgacucgcccga

SEQ ID NO: 8037 - RNA, 51 nt, Artificial Sequence
  Description of Artificial Sequence: Synthetic oligonucleotide
gggaggacgaugcggcaggagaagggagguggcaucagacgacucgcccga

SEQ ID NO: 8038 - RNA, 51 nt, Artificial Sequence
  Description of Artificial Sequence: Synthetic oligonucleotide
gggaggacgaugcggauuggugacgggagguacugcagacgacucgcccga

SEQ ID NO: 8039 - RNA, 50 nt, Artificial Sequence
  Description of Artificial Sequence: Synthetic oligonucleotide
gggaggacgaugcggauuggugaaggagguacugcagacgacucgcccga

SEQ ID NO: 8040 - RNA, 51 nt, Artificial Sequence
  Description of Artificial Sequence: Synthetic oligonucleotide
gggaggacgaugcgggccuuucguuaugaccuccccagacgacucgcccga

SEQ ID NO: 8041 - RNA, 51 nt, Artificial Sequence
  Description of Artificial Sequence: Synthetic oligonucleotide
gggaggacgaugcgguccugucgccuguucguccccagacgacucgcccga

SEQ ID NO: 8042 - RNA, 51 nt, Artificial Sequence
  Description of Artificial Sequence: Synthetic oligonucleotide
gggaggacgaugcggcccuuucguucugcccuccccagacgacucgcccga

SEQ ID NO: 8043 - RNA, 51 nt, Artificial Sequence
  Description of Artificial Sequence: Synthetic oligonucleotide
gggaggacgaugcggauuggugaagggagguaaugcagacgacucgcccga

SEQ ID NO: 8044 - RNA, 51 nt, Artificial Sequence
  Description of Artificial Sequence: Synthetic oligonucleotide
gggaggacgaugcggcaggggagaagggagguugccagacgacucgcccga

SEQ ID NO: 8045 - RNA, 51 nt, Artificial Sequence
  Description of Artificial Sequence: Synthetic oligonucleotide
gggaggacgaugcgggccuuucguucugcccgccccagacgacucgcccga

SEQ ID NO: 8046 - RNA, 51 nt, Artificial Sequence
  Description of Artificial Sequence: Synthetic oligonucleotide
gggaggacgaugcggauuggugaagggagguccugcagacgacucgcccga

SEQ ID NO: 8047 - RNA, 51 nt, Artificial Sequence
  Description of Artificial Sequence: Synthetic oligonucleotide
gggaggacgaugcgguauuggagguguagggacugcagacgacucgcccga

SEQ ID NO: 8048 - RNA, 52 nt, Artificial Sequence
  Description of Artificial Sequence: Synthetic oligonucleotide
gggaggacgaugcgguuugggguuuuucccgugccccagacgacucgcccga

SEQ ID NO: 8049 - RNA, 51 nt, Artificial Sequence
  Description of Artificial Sequence: Synthetic oligonucleotide
gggaggacgaugcggugcugucgucuguucguccccagacgacucgcccga

SEQ ID NO: 8050 - RNA, 51 nt, Artificial Sequence
  Description of Artificial Sequence: Synthetic oligonucleotide
gggaggacgaugcgguccugucuucuguucguccccagacgacucgcccga

SEQ ID NO: 8051 - RNA, 51 nt, Artificial Sequence
  Description of Artificial Sequence: Synthetic oligonucleotide
gggaggacgaugcgguccugucgucuguucguccgcagacgacucgcccga

SEQ ID NO: 8052 - RNA, 49 nt, Artificial Sequence
  Description of Artificial Sequence: Synthetic oligonucleotide
gggaggacgaugcgggccuuucguugaccuccccagacgacucgcccga

SEQ ID NO: 8053 - RNA, 49 nt, Artificial Sequence
  Description of Artificial Sequence: Synthetic oligonucleotide
gggaggacgaugcgguuggguguaggguuaccgcagacgacucgcccga

SEQ ID NO: 8054 - RNA, 51 nt, Artificial Sequence
  Description of Artificial Sequence: Synthetic oligonucleotide
gggaggacgaugcgguuugaagggugaugcguccccagacgacucgcccga

SEQ ID NO: 8055 - RNA, 51 nt, Artificial Sequence
  Description of Artificial Sequence: Synthetic oligonucleotide
gggaggacgaugcggcagaggagaagggaggcugccagacgacucgcccga

SEQ ID NO: 8056 - RNA, 50 nt, Artificial Sequence
  Description of Artificial Sequence: Synthetic oligonucleotide
gggaggacgaugcgggccuuucguuugaccuccccagacgacucgcccga

SEQ ID NO: 8057 - RNA, 50 nt, Artificial Sequence
  Description of Artificial Sequence: Synthetic oligonucleotide
gggaggacgaugcgguccugucgucugucguccccagacgacucgcccga

SEQ ID NO: 8058 - RNA, 51 nt, Artificial Sequence
  Description of Artificial Sequence: Synthetic oligonucleotide
gggaggacgaugcgguguagggggaggagguaccgcagacgacucgcccga

SEQ ID NO: 8059 - RNA, 51 nt, Artificial Sequence
  Description of Artificial Sequence: Synthetic oligonucleotide
gggaggacgaugcggauuggugaagggacguacugcagacgacucgcccga

SEQ ID NO: 8060 - RNA, 51 nt, Artificial Sequence
  Description of Artificial Sequence: Synthetic oligonucleotide
gggaggacgaugcgguguaggaggaggagguuccgcagacgacucgcccga

SEQ ID NO: 8061 - RNA, 51 nt, Artificial Sequence
  Description of Artificial Sequence: Synthetic oligonucleotide
gggaggacgaugcgggccuuucguucuuaccuccccagacgacucgcccga

SEQ ID NO: 8062 - RNA, 51 nt, Artificial Sequence
  Description of Artificial Sequence: Synthetic oligonucleotide
gggaggacgaugcggauugguaaagggagguaccgcagacgacucgcccga

SEQ ID NO: 8063 - RNA, 51 nt, Artificial Sequence
  Description of Artificial Sequence: Synthetic oligonucleotide
gggaggacgaugcggcagaggugaagggagguugccagacgacucgcccga

SEQ ID NO: 8064 - RNA, 51 nt, Artificial Sequence
  Description of Artificial Sequence: Synthetic oligonucleotide
gggaggacgaugcggauagguguagggagguuuagcagacgacucgcccga

SEQ ID NO: 8065 - RNA, 50 nt, Artificial Sequence
  Description of Artificial Sequence: Synthetic oligonucleotide
gggaggacgaugcgggccuuuguucugcccuccccagacgacucgcccga

SEQ ID NO: 8066 - RNA, 52 nt, Artificial Sequence
  Description of Artificial Sequence: Synthetic oligonucleotide
gggaggacgaugcgguuggguguagggugguuaccgcagacgacucgcccga

SEQ ID NO: 8067 - RNA, 51 nt, Artificial Sequence
  Description of Artificial Sequence: Synthetic oligonucleotide
gggaggacgaugcggauuggugaagggaguuaccgcagacgacucgcccga

SEQ ID NO: 8068 - RNA, 50 nt, Artificial Sequence
  Description of Artificial Sequence: Synthetic oligonucleotide
gggaggacgaugcgguuugaagggugauggggugcagacgacucgcccga

SEQ ID NO: 8069 - RNA, 51 nt, Artificial Sequence
  Description of Artificial Sequence: Synthetic oligonucleotide
gggaggacgaugcgggccuuacguucugcccuccccagacgacucgcccga

SEQ ID NO: 8070 - RNA, 51 nt, Artificial Sequence
  Description of Artificial Sequence: Synthetic oligonucleotide
gggaggacgaugcgguuggguguaggguggguccgcagacgacucgcccga

SEQ ID NO: 8071 - RNA, 51 nt, Artificial Sequence
  Description of Artificial Sequence: Synthetic oligonucleotide
gggaggacgaugcggauagggagaagggugauccgcagacgacucgcccga

SEQ ID NO: 8072 - RNA, 51 nt, Artificial Sequence
  Description of Artificial Sequence: Synthetic oligonucleotide
gggaggacgaugcggaguggugaagggagguacugcagacgacucgcccga

SEQ ID NO: 8073 - RNA, 51 nt, Artificial Sequence
  Description of Artificial Sequence: Synthetic oligonucleotide
gggaggacgaugcggcagaggaggagggagguugccagacgacucgcccga

SEQ ID NO: 8074 - RNA, 51 nt, Artificial Sequence
  Description of Artificial Sequence: Synthetic oligonucleotide
gggaggacgaugcgguguaggaggaggaguuaccgcagacgacucgcccga

SEQ ID NO: 8075 - RNA, 50 nt, Artificial Sequence
  Description of Artificial Sequence: Synthetic oligonucleotide
gggaggacgaugcgguuugaaggguauggguccgcagacgacucgcccga

SEQ ID NO: 8076 - RNA, 51 nt, Artificial Sequence
  Description of Artificial Sequence: Synthetic oligonucleotide
gggaggacgaugcggcauaggagaagggagguugccagacgacucgcccga

SEQ ID NO: 8077 - RNA, 51 nt, Artificial Sequence
  Description of Artificial Sequence: Synthetic oligonucleotide
gggaggacgaugcgggaucaugcuuucccuucguccagacgacucgcccga

SEQ ID NO: 8078 - RNA, 51 nt, Artificial Sequence
  Description of Artificial Sequence: Synthetic oligonucleotide
gggaggacgaugcggcagaggagaagggugguugccagacgacucgcccga

SEQ ID NO: 8079 - RNA, 51 nt, Artificial Sequence
  Description of Artificial Sequence: Synthetic oligonucleotide
gggaggacgaugcgguuugaagggugguggguccccagacgacucgcccga

SEQ ID NO: 8080 - RNA, 51 nt, Artificial Sequence
  Description of Artificial Sequence: Synthetic oligonucleotide
gggaggacgaugcgguucgguguagggugguaccgcagacgacucgcccga

SEQ ID NO: 8081 - RNA, 51 nt, Artificial Sequence
  Description of Artificial Sequence: Synthetic oligonucleotide
gggaggacgaugcggcguuuccucugguucgucaccagacgacucgcccga

SEQ ID NO: 8082 - RNA, 51 nt, Artificial Sequence
  Description of Artificial Sequence: Synthetic oligonucleotide
gggaggacgaugcggcuguccuuauucugcagguccagacgacucgcccga

SEQ ID NO: 8083 - RNA, 51 nt, Artificial Sequence
  Description of Artificial Sequence: Synthetic oligonucleotide
gggaggacgaugcgguuugggguuuccccgugccccagacgacucgcccga

SEQ ID NO: 8084 - RNA, 52 nt, Artificial Sequence
  Description of Artificial Sequence: Synthetic oligonucleotide
gggaggacgaugcgggccuuucguucugaccucccccagacgacucgcccga

SEQ ID NO: 8085 - RNA, 49 nt, Artificial Sequence
  Description of Artificial Sequence: Synthetic oligonucleotide
gggaggacgaugcgguuugaagggauggguccgcagacgacucgcccga

SEQ ID NO: 8086 - RNA, 51 nt, Artificial Sequence
  Description of Artificial Sequence: Synthetic oligonucleotide
gggaggacgaugcggcguaggaggaggagguaccgcagacgacucgcccga

SEQ ID NO: 8087 - RNA, 51 nt, Artificial Sequence
  Description of Artificial Sequence: Synthetic oligonucleotide
gggaggacgaugcggaaucguucuccucgucuggccagacgacucgcccga

SEQ ID NO: 8088 - RNA, 51 nt, Artificial Sequence
  Description of Artificial Sequence: Synthetic oligonucleotide
gggaggacgaugcgggccuuucguucucuucuccccagacgacucgcccga

SEQ ID NO: 8089 - RNA, 51 nt, Artificial Sequence
  Description of Artificial Sequence: Synthetic oligonucleotide
gggaggacgaugcgguuuggaguagggugguaccgcagacgacucgcccga

SEQ ID NO: 8090 - RNA, 51 nt, Artificial Sequence
  Description of Artificial Sequence: Synthetic oligonucleotide
gggaggacgaugcggaguugguggaggugguuucgcagacgacucgcccga

SEQ ID NO: 8091 - RNA, 51 nt, Artificial Sequence
  Description of Artificial Sequence: Synthetic oligonucleotide
gggaggacgaugcgggccuuucguucugagcuccccagacgacucgcccga

SEQ ID NO: 8092 - RNA, 49 nt, Artificial Sequence
  Description of Artificial Sequence: Synthetic oligonucleotide
gggaggacgaugcgggccuuucguucugaccuccagacgacucgcccga

SEQ ID NO: 8093 - RNA, 52 nt, Artificial Sequence
  Description of Artificial Sequence: Synthetic oligonucleotide
gggaggacgaugcggguccugucgucugcucguccccagacgacucgcccga

SEQ ID NO: 8094 - RNA, 51 nt, Artificial Sequence
  Description of Artificial Sequence: Synthetic oligonucleotide
gggaggacgaugcgggaugacggcgguugucuuaccagacgacucgcccga

SEQ ID NO: 8095 - RNA, 51 nt, Artificial Sequence
  Description of Artificial Sequence: Synthetic oligonucleotide
gggaggacgaugcggacuggugaagggagguaccgcagacgacucgcccga

SEQ ID NO: 8096 - RNA, 51 nt, Artificial Sequence
  Description of Artificial Sequence: Synthetic oligonucleotide
gggaggacgaugcgguuugcagggcgauggguccgcagacgacucgcccga

SEQ ID NO: 8097 - RNA, 51 nt, Artificial Sequence
  Description of Artificial Sequence: Synthetic oligonucleotide
gggaggacgaugcgguuggggguagggggguaccgcagacgacucgcccga

SEQ ID NO: 8098 - RNA, 51 nt, Artificial Sequence
  Description of Artificial Sequence: Synthetic oligonucleotide
gggaggacgaugcgggccuuuaguucugaccuccccagacgacucgcccga

SEQ ID NO: 8099 - RNA, 51 nt, Artificial Sequence
  Description of Artificial Sequence: Synthetic oligonucleotide
gggaggacgaugcgggccuuucggucugaccuccccagacgacucgcccga

SEQ ID NO: 8100 - RNA, 51 nt, Artificial Sequence
  Description of Artificial Sequence: Synthetic oligonucleotide
gggaggacgaugcgguuggguguagggugguaacgcagacgacucgcccga

SEQ ID NO: 8101 - RNA, 51 nt, Artificial Sequence
  Description of Artificial Sequence: Synthetic oligonucleotide
gggaggacgaugcgguguaggagguggagguaccgcagacgacucgcccga

SEQ ID NO: 8102 - RNA, 51 nt, Artificial Sequence
  Description of Artificial Sequence: Synthetic oligonucleotide
gggaggacgaugcgguuugaaaagugauggguccgcagacgacucgcccga

SEQ ID NO: 8103 - RNA, 51 nt, Artificial Sequence
  Description of Artificial Sequence: Synthetic oligonucleotide
gggaggacgaugcgggccuuucguucggcccuccccagacgacucgcccga

SEQ ID NO: 8104 - RNA, 51 nt, Artificial Sequence
  Description of Artificial Sequence: Synthetic oligonucleotide
gggaggacgaugcggcagaggggaagggagguugccagacgacucgcccga

SEQ ID NO: 8105 - RNA, 50 nt, Artificial Sequence
  Description of Artificial Sequence: Synthetic oligonucleotide
gggaggacgaugcgguccuugucgucuugcgccccagacgacucgcccga

SEQ ID NO: 8106 - RNA, 51 nt, Artificial Sequence
  Description of Artificial Sequence: Synthetic oligonucleotide
gggaggacgaugcgggccuuucguucugacguccccagacgacucgcccga

SEQ ID NO: 8107 - RNA, 52 nt, Artificial Sequence
  Description of Artificial Sequence: Synthetic oligonucleotide
gggaggacgaugcgguuugaagggugauggguacugcagacgacucgcccga

SEQ ID NO: 8108 - RNA, 51 nt, Artificial Sequence
  Description of Artificial Sequence: Synthetic oligonucleotide
gggaggacgaugcggaguaaccuguugaacugcaccagacgacucgcccga

SEQ ID NO: 8109 - RNA, 51 nt, Artificial Sequence
  Description of Artificial Sequence: Synthetic oligonucleotide
gggaggacgaugcgguuugaaggguggcggguccgcagacgacucgcccga

SEQ ID NO: 8110 - RNA, 50 nt, Artificial Sequence
  Description of Artificial Sequence: Synthetic oligonucleotide
gggaggacgaugcgguuggguguaggguggugcgcagacgacucgcccga

SEQ ID NO: 8111 - RNA, 51 nt, Artificial Sequence
  Description of Artificial Sequence: Synthetic oligonucleotide
gggaggacgaugcgguuugguggagggugggaccgcagacgacucgcccga

SEQ ID NO: 8112 - RNA, 51 nt, Artificial Sequence
  Description of Artificial Sequence: Synthetic oligonucleotide
gggaggacgaugcgguccuagguugucuuauucugcagacgacucgcccga

SEQ ID NO: 8113 - RNA, 51 nt, Artificial Sequence
  Description of Artificial Sequence: Synthetic oligonucleotide
gggaggacgaugcggguccucuggcuuaucguccccagacgacucgcccga

SEQ ID NO: 8114 - RNA, 52 nt, Artificial Sequence
  Description of Artificial Sequence: Synthetic oligonucleotide
gggaggacgaugcgguuugaagggugauggguuccgcagacgacucgcccga

SEQ ID NO: 8115 - RNA, 51 nt, Artificial Sequence
  Description of Artificial Sequence: Synthetic oligonucleotide
gggaggacgaugcgguuuggaggaggaugggaccgcagacgacucgcccga

SEQ ID NO: 8116 - RNA, 51 nt, Artificial Sequence
  Description of Artificial Sequence: Synthetic oligonucleotide
gggaggacgaugcgguuuggggucuucccgugccccagacgacucgcccga

SEQ ID NO: 8117 - RNA, 51 nt, Artificial Sequence
  Description of Artificial Sequence: Synthetic oligonucleotide
gggaggacgaugcgguccugucgucuguucgcccccagacgacucgcccga

SEQ ID NO: 8118 - RNA, 51 nt, Artificial Sequence
  Description of Artificial Sequence: Synthetic oligonucleotide
gggaggacgaugcggauuggucaagggagguacugcagacgacucgcccga

SEQ ID NO: 8119 - RNA, 51 nt, Artificial Sequence
  Description of Artificial Sequence: Synthetic oligonucleotide
gggaggacgaugcgguuugaagggugaugggucuucagacgacucgcccga

SEQ ID NO: 8120 - RNA, 51 nt, Artificial Sequence
  Description of Artificial Sequence: Synthetic oligonucleotide
gggaggacgaugcggcguuuuauacugcaagugcccagacgacucgcccga

SEQ ID NO: 8121 - RNA, 49 nt, Artificial Sequence
  Description of Artificial Sequence: Synthetic oligonucleotide
gggaggacgaugcgguuggguguagggugguaccagacgacucgcccga

SEQ ID NO: 8122 - RNA, 51 nt, Artificial Sequence
  Description of Artificial Sequence: Synthetic oligonucleotide
gggaggacgaugcggugugggaggaggagguaccgcagacgacucgcccga

SEQ ID NO: 8123 - RNA, 51 nt, Artificial Sequence
  Description of Artificial Sequence: Synthetic oligonucleotide
gggaggacgaugcgguuggggguagggcgguaccgcagacgacucgcccga

SEQ ID NO: 8124 - RNA, 51 nt, Artificial Sequence
  Description of Artificial Sequence: Synthetic oligonucleotide
gggaggacgaugcgguuuggaguagggugggaccgcagacgacucgcccga

SEQ ID NO: 8125 - RNA, 51 nt, Artificial Sequence
  Description of Artificial Sequence: Synthetic oligonucleotide
gggaggacgaugcgguccugucgucuguuuguccccagacgacucgcccga

SEQ ID NO: 8126 - RNA, 51 nt, Artificial Sequence
  Description of Artificial Sequence: Synthetic oligonucleotide
gggaggacgaugcgguucgaagggugguggguccgcagacgacucgcccga

SEQ ID NO: 8127 - RNA, 51 nt, Artificial Sequence
  Description of Artificial Sequence: Synthetic oligonucleotide
gggaggacgaugcgguugggaguagggcgguaccgcagacgacucgcccga

SEQ ID NO: 8128 - RNA, 51 nt, Artificial Sequence
  Description of Artificial Sequence: Synthetic oligonucleotide
gggaggacgaugcgguuuggagggugaugggaccgcagacgacucgcccga

SEQ ID NO: 8129 - RNA, 51 nt, Artificial Sequence
  Description of Artificial Sequence: Synthetic oligonucleotide
gggaggacgaugcgguccugccgucuguucguccccagacgacucgcccga

SEQ ID NO: 8130 - RNA, 51 nt, Artificial Sequence
  Description of Artificial Sequence: Synthetic oligonucleotide
gggaggacgaugcggauuggugaaaggagguaccgcagacgacucgcccga

SEQ ID NO: 8131 - RNA, 52 nt, Artificial Sequence
  Description of Artificial Sequence: Synthetic oligonucleotide
gggaggacgaugcggugacucgucuguuuucguccccagacgacucgcccga

SEQ ID NO: 8132 - RNA, 51 nt, Artificial Sequence
  Description of Artificial Sequence: Synthetic oligonucleotide
gggaggacgaugcgguuugaaggaggaugggaccgcagacgacucgcccga

SEQ ID NO: 8133 - RNA, 51 nt, Artificial Sequence
  Description of Artificial Sequence: Synthetic oligonucleotide
gggaggacgaugcgguugcguguagggugguaccgcagacgacucgcccga

SEQ ID NO: 8134 - RNA, 51 nt, Artificial Sequence
  Description of Artificial Sequence: Synthetic oligonucleotide
gggaggacgaugcgguuggguguagcgugguaccgcagacgacucgcccga

SEQ ID NO: 8135 - RNA, 51 nt, Artificial Sequence
  Description of Artificial Sequence: Synthetic oligonucleotide
gggaggacgaugcgguuugaagggggauggggccgcagacgacucgcccga

SEQ ID NO: 8136 - RNA, 51 nt, Artificial Sequence
  Description of Artificial Sequence: Synthetic oligonucleotide
gggaggacgaugcggcuaagaaagggagguggugccagacgacucgcccga

SEQ ID NO: 8137 - RNA, 51 nt, Artificial Sequence
  Description of Artificial Sequence: Synthetic oligonucleotide
gggaggacgaugcgguucugucgucuguucguccccagacgacucgcccga

SEQ ID NO: 8138 - RNA, 51 nt, Artificial Sequence
  Description of Artificial Sequence: Synthetic oligonucleotide
gggaggacgaugcgguccugucgucuuuucguccccagacgacucgcccga

SEQ ID NO: 8139 - RNA, 51 nt, Artificial Sequence
  Description of Artificial Sequence: Synthetic oligonucleotide
gggaggacgaugcgguggaggaggaggagguaccgcagacgacucgcccga

SEQ ID NO: 8140 - RNA, 51 nt, Artificial Sequence
  Description of Artificial Sequence: Synthetic oligonucleotide
gggaggacgaugcgguguagaaggaggagguaccgcagacgacucgcccga

SEQ ID NO: 8141 - RNA, 51 nt, Artificial Sequence
  Description of Artificial Sequence: Synthetic oligonucleotide
gggaggacgaugcgguauuggaggaguagggaccgcagacgacucgcccga

SEQ ID NO: 8142 - RNA, 51 nt, Artificial Sequence
  Description of Artificial Sequence: Synthetic oligonucleotide
gggaggacgaugcggaaacgagccgucuuauccugcagacgacucgcccga

SEQ ID NO: 8143 - RNA, 51 nt, Artificial Sequence
  Description of Artificial Sequence: Synthetic oligonucleotide
gggaggacgaugcgguuuggggcuuucccgugccccagacgacucgcccga

SEQ ID NO: 8144 - RNA, 51 nt, Artificial Sequence
  Description of Artificial Sequence: Synthetic oligonucleotide
gggaggacgaugcgguccugucgucuguucguuuccagacgacucgcccga

SEQ ID NO: 8145 - RNA, 51 nt, Artificial Sequence
  Description of Artificial Sequence: Synthetic oligonucleotide
gggaggacgaugcggcguuucaucugguucguccccagacgacucgcccga

SEQ ID NO: 8146 - RNA, 51 nt, Artificial Sequence
  Description of Artificial Sequence: Synthetic oligonucleotide
gggaggacgaugcgggaugaaggccugucguguaccagacgacucgcccga

SEQ ID NO: 8147 - RNA, 51 nt, Artificial Sequence
  Description of Artificial Sequence: Synthetic oligonucleotide
gggaggacgaugcggcaauaggaggaguggggcgccagacgacucgcccga

SEQ ID NO: 8148 - RNA, 51 nt, Artificial Sequence
  Description of Artificial Sequence: Synthetic oligonucleotide
gggaggacgaugcggauuggugaaggcagguacugcagacgacucgcccga

SEQ ID NO: 8149 - RNA, 51 nt, Artificial Sequence
  Description of Artificial Sequence: Synthetic oligonucleotide
gggaggacgaugcgguguuggagguguagggaccgcagacgacucgcccga

SEQ ID NO: 8150 - RNA, 51 nt, Artificial Sequence
  Description of Artificial Sequence: Synthetic oligonucleotide
gggaggacgaugcggcuugaagggugguggguccgcagacgacucgcccga

SEQ ID NO: 8151 - RNA, 51 nt, Artificial Sequence
  Description of Artificial Sequence: Synthetic oligonucleotide
gggaggacgaugcgguuugaagggagcuggguccgcagacgacucgcccga

SEQ ID NO: 8152 - RNA, 51 nt, Artificial Sequence
  Description of Artificial Sequence: Synthetic oligonucleotide
gggaggacgaugcgggccuuucguugugcccuccccagacgacucgcccga

SEQ ID NO: 8153 - RNA, 51 nt, Artificial Sequence
  Description of Artificial Sequence: Synthetic oligonucleotide
gggaggacgaugcgggccuuucguucagaccuccccagacgacucgcccga

SEQ ID NO: 8154 - RNA, 51 nt, Artificial Sequence
  Description of Artificial Sequence: Synthetic oligonucleotide
gggaggacgaugcgggccuuucguucugaccuuuccagacgacucgcccga

SEQ ID NO: 8155 - RNA, 51 nt, Artificial Sequence
  Description of Artificial Sequence: Synthetic oligonucleotide
gggaggacgaugcgggccuuucguuuugaccuccccagacgacucgcccga

SEQ ID NO: 8156 - RNA, 51 nt, Artificial Sequence
  Description of Artificial Sequence: Synthetic oligonucleotide
gggaggacgaugcggauuggggaagggagguaccgcagacgacucgcccga

SEQ ID NO: 8157 - RNA, 51 nt, Artificial Sequence
  Description of Artificial Sequence: Synthetic oligonucleotide
gggaggacgaugcggugcaggaggaggagguaccgcagacgacucgcccga

SEQ ID NO: 8158 - RNA, 51 nt, Artificial Sequence
  Description of Artificial Sequence: Synthetic oligonucleotide
gggaggacgaugcgggccuuugguucugcccuccccagacgacucgcccga

SEQ ID NO: 8159 - RNA, 50 nt, Artificial Sequence
  Description of Artificial Sequence: Synthetic oligonucleotide
gggaggacgaugcggauugggaagggagguacugcagacgacucgcccga

SEQ ID NO: 8160 - RNA, 51 nt, Artificial Sequence
  Description of Artificial Sequence: Synthetic oligonucleotide
gggaggacgaugcggauagggaggagggugaaccgcagacgacucgcccga

SEQ ID NO: 8161 - RNA, 52 nt, Artificial Sequence
  Description of Artificial Sequence: Synthetic oligonucleotide
gggaggacgaugcgguuugaagggugauaggguccgcagacgacucgcccga

SEQ ID NO: 8162 - RNA, 50 nt, Artificial Sequence
  Description of Artificial Sequence: Synthetic oligonucleotide
gggaggacgaugcgguuggguuagggugguaccgcagacgacucgcccga

SEQ ID NO: 8163 - RNA, 51 nt, Artificial Sequence
  Description of Artificial Sequence: Synthetic oligonucleotide
gggaggacgaugcgguuugaagggcgcuggguccgcagacgacucgcccga

SEQ ID NO: 8164 - RNA, 51 nt, Artificial Sequence
  Description of Artificial Sequence: Synthetic oligonucleotide
gggaggacgaugcggcuugaagggagauggguccgcagacgacucgcccga

SEQ ID NO: 8165 - RNA, 50 nt, Artificial Sequence
  Description of Artificial Sequence: Synthetic oligonucleotide
gggaggacgaugcgguuggugaagggagguacugcagacgacucgcccga

SEQ ID NO: 8166 - RNA, 51 nt, Artificial Sequence
  Description of Artificial Sequence: Synthetic oligonucleotide
gggaggacgaugcgguuugaagggagaugggaccgcagacgacucgcccga

SEQ ID NO: 8167 - RNA, 52 nt, Artificial Sequence
  Description of Artificial Sequence: Synthetic oligonucleotide
gggaggacgaugcgggccuuuucguucugaccuccccagacgacucgcccga

SEQ ID NO: 8168 - RNA, 51 nt, Artificial Sequence
  Description of Artificial Sequence: Synthetic oligonucleotide
gggaggacgaugcggauucgugaagggagguacugcagacgacucgcccga

SEQ ID NO: 8169 - RNA, 51 nt, Artificial Sequence
  Description of Artificial Sequence: Synthetic oligonucleotide
gggaggacgaugcgguuggguguagggucguaccgcagacgacucgcccga

SEQ ID NO: 8170 - RNA, 51 nt, Artificial Sequence
  Description of Artificial Sequence: Synthetic oligonucleotide
gggaggacgaugcggugaaggaggaggagguaccgcagacgacucgcccga

SEQ ID NO: 8171 - RNA, 53 nt, Artificial Sequence
  Description of Artificial Sequence: Synthetic oligonucleotide
gggaggacgaugcgguuuuugaagggugauggguccgcagacgacucgcccga

SEQ ID NO: 8172 - RNA, 51 nt, Artificial Sequence
  Description of Artificial Sequence: Synthetic oligonucleotide
gggaggacgaugcggcaucgguucucaucguugugcagacgacucgcccga

SEQ ID NO: 8173 - RNA, 51 nt, Artificial Sequence
  Description of Artificial Sequence: Synthetic oligonucleotide
gggaggacgaugcggcugaggagaagggagguugccagacgacucgcccga

SEQ ID NO: 8174 - RNA, 49 nt, Artificial Sequence
  Description of Artificial Sequence: Synthetic oligonucleotide
gggaggacgaugcgguccugucgucuguucguccagacgacucgcccga

SEQ ID NO: 8175 - RNA, 51 nt, Artificial Sequence
  Description of Artificial Sequence: Synthetic oligonucleotide
gggaggacgaugcgguguaggaggagaagguaccgcagacgacucgcccga

SEQ ID NO: 8176 - RNA, 51 nt, Artificial Sequence
  Description of Artificial Sequence: Synthetic oligonucleotide
gggaggacgaugcggaugggugaagggagguaccgcagacgacucgcccga

SEQ ID NO: 8177 - RNA, 51 nt, Artificial Sequence
  Description of Artificial Sequence: Synthetic oligonucleotide
gggaggacgaugcgguccugucgucuguucauccccagacgacucgcccga

SEQ ID NO: 8178 - RNA, 51 nt, Artificial Sequence
  Description of Artificial Sequence: Synthetic oligonucleotide
gggaggacgaugcgggccuuucguucucaccuccccagacgacucgcccga

SEQ ID NO: 8179 - RNA, 51 nt, Artificial Sequence
  Description of Artificial Sequence: Synthetic oligonucleotide
gggaggacgaugcgguuugaagggcgaugggcccgcagacgacucgcccga

SEQ ID NO: 8180 - RNA, 51 nt, Artificial Sequence
  Description of Artificial Sequence: Synthetic oligonucleotide
gggaggacgaugcggauuggugaagagagguaccgcagacgacucgcccga

SEQ ID NO: 8181 - RNA, 51 nt, Artificial Sequence
  Description of Artificial Sequence: Synthetic oligonucleotide
gggaggacgaugcgguuggaagggggauggguccgcagacgacucgcccga

SEQ ID NO: 8182 - RNA, 51 nt, Artificial Sequence
  Description of Artificial Sequence: Synthetic oligonucleotide
gggaggacgaugcgguuuggagggggguggguccgcagacgacucgcccga

SEQ ID NO: 8183 - RNA, 51 nt, Artificial Sequence
  Description of Artificial Sequence: Synthetic oligonucleotide
gggaggacgaugcgguugggcguagggcgguaccgcagacgacucgcccga

SEQ ID NO: 8184 - RNA, 51 nt, Artificial Sequence
  Description of Artificial Sequence: Synthetic oligonucleotide
gggaggacgaugcgguuugaagggagaugggcccgcagacgacucgcccga

SEQ ID NO: 8185 - RNA, 51 nt, Artificial Sequence
  Description of Artificial Sequence: Synthetic oligonucleotide
gggaggacgaugcgguuugaaggguggaggguccgcagacgacucgcccga

SEQ ID NO: 8186 - RNA, 51 nt, Artificial Sequence
  Description of Artificial Sequence: Synthetic oligonucleotide
gggaggacgaugcgguuugcagggagauggguccgcagacgacucgcccga

SEQ ID NO: 8187 - RNA, 51 nt, Artificial Sequence
  Description of Artificial Sequence: Synthetic oligonucleotide
gggaggacgaugcgguagaggagaagggagguugccagacgacucgcccga

SEQ ID NO: 8188 - RNA, 49 nt, Artificial Sequence
  Description of Artificial Sequence: Synthetic oligonucleotide
gggaggacgaugcgggccuuucguucugccccccagacgacucgcccga

SEQ ID NO: 8189 - RNA, 52 nt, Artificial Sequence
  Description of Artificial Sequence: Synthetic oligonucleotide
gggaggacgaugcggguguucgucuguuuucguccccagacgacucgcccga

SEQ ID NO: 8190 - RNA, 52 nt, Artificial Sequence
  Description of Artificial Sequence: Synthetic oligonucleotide
gggaggacgaugcgguuugaagggugauggguaccucagacgacucgcccga

SEQ ID NO: 8191 - RNA, 51 nt, Artificial Sequence
  Description of Artificial Sequence: Synthetic oligonucleotide
gggaggacgaugcggcagaggagaggggagguugccagacgacucgcccga

SEQ ID NO: 8192 - RNA, 51 nt, Artificial Sequence
  Description of Artificial Sequence: Synthetic oligonucleotide
gggaggacgaugcgggccuuucguucugaccaccccagacgacucgcccga

SEQ ID NO: 8193 - RNA, 51 nt, Artificial Sequence
  Description of Artificial Sequence: Synthetic oligonucleotide
gggaggacgaugcggauuagugaagggagguaccgcagacgacucgcccga

SEQ ID NO: 8194 - RNA, 50 nt, Artificial Sequence
  Description of Artificial Sequence: Synthetic oligonucleotide
gggaggacgaugcgggccuuuguucugaccuccccagacgacucgcccga

SEQ ID NO: 8195 - RNA, 51 nt, Artificial Sequence
  Description of Artificial Sequence: Synthetic oligonucleotide
gggaggacgaugcggguagggagaagggugaaccgcagacgacucgcccga

SEQ ID NO: 8196 - RNA, 51 nt, Artificial Sequence
  Description of Artificial Sequence: Synthetic oligonucleotide
gggaggacgaugcgguauuggggguguagggaccgcagacgacucgcccga

SEQ ID NO: 8197 - RNA, 51 nt, Artificial Sequence
  Description of Artificial Sequence: Synthetic oligonucleotide
gggaggacgaugcggauuggugaagggagguagugcagacgacucgcccga

SEQ ID NO: 8198 - RNA, 51 nt, Artificial Sequence
  Description of Artificial Sequence: Synthetic oligonucleotide
gggaggacgaugcgguugggaguagggagguaccgcagacgacucgcccga

SEQ ID NO: 8199 - RNA, 50 nt, Artificial Sequence
  Description of Artificial Sequence: Synthetic oligonucleotide
gggaggacgaugcgguccugucgucuugcguccccagacgacucgcccga

SEQ ID NO: 8200 - RNA, 51 nt, Artificial Sequence
  Description of Artificial Sequence: Synthetic oligonucleotide
gggaggacgaugcggauagggaggaggugaaugugcagacgacucgcccga

SEQ ID NO: 8201 - RNA, 50 nt, Artificial Sequence
  Description of Artificial Sequence: Synthetic oligonucleotide
gggaggacgaugcgguuggguguagggugaaccgcagacgacucgcccga

SEQ ID NO: 8202 - RNA, 51 nt, Artificial Sequence
  Description of Artificial Sequence: Synthetic oligonucleotide
gggaggacgaugcgguguuggaggaggagguaccgcagacgacucgcccga

SEQ ID NO: 8203 - RNA, 51 nt, Artificial Sequence
  Description of Artificial Sequence: Synthetic oligonucleotide
gggaggacgaugcgggccuuucuuucugaccuccccagacgacucgcccga

SEQ ID NO: 8204 - RNA, 51 nt, Artificial Sequence
  Description of Artificial Sequence: Synthetic oligonucleotide
gggaggacgaugcggauuggugaagcgagguacugcagacgacucgcccga

SEQ ID NO: 8205 - RNA, 52 nt, Artificial Sequence
  Description of Artificial Sequence: Synthetic oligonucleotide
gggaggacgaugcgguuugaaagggugauggguccgcagacgacucgcccga

SEQ ID NO: 8206 - RNA, 51 nt, Artificial Sequence
  Description of Artificial Sequence: Synthetic oligonucleotide
gggaggacgaugcgggaugacggcggugucgcuaccagacgacucgcccga

SEQ ID NO: 8207 - RNA, 51 nt, Artificial Sequence
  Description of Artificial Sequence: Synthetic oligonucleotide
gggaggacgaugcgggccguucguucugcccuccccagacgacucgcccga

SEQ ID NO: 8208 - RNA, 51 nt, Artificial Sequence
  Description of Artificial Sequence: Synthetic oligonucleotide
gggaggacgaugcggauugcugaagggagguacugcagacgacucgcccga

SEQ ID NO: 8209 - RNA, 51 nt, Artificial Sequence
  Description of Artificial Sequence: Synthetic oligonucleotide
gggaggacgaugcgguuggguguagggcguuaccgcagacgacucgcccga

SEQ ID NO: 8210 - RNA, 51 nt, Artificial Sequence
  Description of Artificial Sequence: Synthetic oligonucleotide
gggaggacgaugcgguuugaagggggaugggcccgcagacgacucgcccga

SEQ ID NO: 8211 - RNA, 51 nt, Artificial Sequence
  Description of Artificial Sequence: Synthetic oligonucleotide
gggaggacgaugcgguuugacgggcgauggguccgcagacgacucgcccga

SEQ ID NO: 8212 - RNA, 51 nt, Artificial Sequence
  Description of Artificial Sequence: Synthetic oligonucleotide
gggaggacgaugcgguuugacgggagauggguccgcagacgacucgcccga

SEQ ID NO: 8213 - RNA, 51 nt, Artificial Sequence
  Description of Artificial Sequence: Synthetic oligonucleotide
gggaggacgaugcgguccuaucgucuguucguccccagacgacucgcccga

SEQ ID NO: 8214 - RNA, 51 nt, Artificial Sequence
  Description of Artificial Sequence: Synthetic oligonucleotide
gggaggacgaugcgggcguuucguucugcccuccccagacgacucgcccga

SEQ ID NO: 8215 - RNA, 49 nt, Artificial Sequence
  Description of Artificial Sequence: Synthetic oligonucleotide
gggaggacgaugcgguuugaggugauggguccgcagacgacucgcccga

SEQ ID NO: 8216 - RNA, 50 nt, Artificial Sequence
  Description of Artificial Sequence: Synthetic oligonucleotide
gggaggacgaugcgguuugaagggugaggguccgcagacgacucgcccga

SEQ ID NO: 8217 - RNA, 51 nt, Artificial Sequence
  Description of Artificial Sequence: Synthetic oligonucleotide
gggaggacgaugcgguuugaagggggaugggucugcagacgacucgcccga

SEQ ID NO: 8218 - RNA, 51 nt, Artificial Sequence
  Description of Artificial Sequence: Synthetic oligonucleotide
gggaggacgaugcgguuugaagggggaugguuccgcagacgacucgcccga

SEQ ID NO: 8219 - RNA, 51 nt, Artificial Sequence
  Description of Artificial Sequence: Synthetic oligonucleotide
gggaggacgaugcgguuugaaggggguuggguccgcagacgacucgcccga

SEQ ID NO: 8220 - RNA, 51 nt, Artificial Sequence
  Description of Artificial Sequence: Synthetic oligonucleotide
gggaggacgaugcggaguuggaggagggaggucugcagacgacucgcccga

SEQ ID NO: 8221 - RNA, 51 nt, Artificial Sequence
  Description of Artificial Sequence: Synthetic oligonucleotide
gggaggacgaugcgguccugucgucuguucguccacagacgacucgcccga

SEQ ID NO: 8222 - RNA, 51 nt, Artificial Sequence
  Description of Artificial Sequence: Synthetic oligonucleotide
gggaggacgaugcggauuggugaugggagguaccgcagacgacucgcccga

SEQ ID NO: 8223 - RNA, 51 nt, Artificial Sequence
  Description of Artificial Sequence: Synthetic oligonucleotide
gggaggacgaugcgguuuggagggugguggguccgcagacgacucgcccga

SEQ ID NO: 8224 - RNA, 51 nt, Artificial Sequence
  Description of Artificial Sequence: Synthetic oligonucleotide
gggaggacgaugcgguuugguguagggugggaccgcagacgacucgcccga

SEQ ID NO: 8225 - RNA, 51 nt, Artificial Sequence
  Description of Artificial Sequence: Synthetic oligonucleotide
gggaggacgaugcgguccugucgucuguucgucuccagacgacucgcccga

SEQ ID NO: 8226 - RNA, 51 nt, Artificial Sequence
  Description of Artificial Sequence: Synthetic oligonucleotide
gggaggacgaugcggcgacuaugucgucuugcccccagacgacucgcccga

SEQ ID NO: 8227 - RNA, 51 nt, Artificial Sequence
  Description of Artificial Sequence: Synthetic oligonucleotide
gggaggacgaugcggcggaggagaagggagguugccagacgacucgcccga

SEQ ID NO: 8228 - RNA, 51 nt, Artificial Sequence
  Description of Artificial Sequence: Synthetic oligonucleotide
gggaggacgaugcgggccuuucguucugaacuccccagacgacucgcccga

SEQ ID NO: 8229 - RNA, 50 nt, Artificial Sequence
  Description of Artificial Sequence: Synthetic oligonucleotide
gggaggacgaugcgguuugggguuuucccugccccagacgacucgcccga

SEQ ID NO: 8230 - RNA, 51 nt, Artificial Sequence
  Description of Artificial Sequence: Synthetic oligonucleotide
gggaggacgaugcggauugaugaagggagguaccgcagacgacucgcccga

SEQ ID NO: 8231 - RNA, 51 nt, Artificial Sequence
  Description of Artificial Sequence: Synthetic oligonucleotide
gggaggacgaugcgguugggcguagggagguaccgcagacgacucgcccga

SEQ ID NO: 8232 - RNA, 52 nt, Artificial Sequence
  Description of Artificial Sequence: Synthetic oligonucleotide
gggaggacgaugcgguuuugaagggugauggguccccagacgacucgcccga

SEQ ID NO: 8233 - RNA, 51 nt, Artificial Sequence
  Description of Artificial Sequence: Synthetic oligonucleotide
gggaggacgaugcgguugggaggggggugggaccgcagacgacucgcccga

SEQ ID NO: 8234 - RNA, 51 nt, Artificial Sequence
  Description of Artificial Sequence: Synthetic oligonucleotide
gggaggacgaugcgguuugaagggagauggggccgcagacgacucgcccga

SEQ ID NO: 8235 - RNA, 51 nt, Artificial Sequence
  Description of Artificial Sequence: Synthetic oligonucleotide
gggaggacgaugcgguuugaagucgucuuauccugcagacgacucgcccga

SEQ ID NO: 8236 - RNA, 51 nt, Artificial Sequence
  Description of Artificial Sequence: Synthetic oligonucleotide
gggaggacgaugcgggccuuucguacugcccuccccagacgacucgcccga

SEQ ID NO: 8237 - RNA, 50 nt, Artificial Sequence
  Description of Artificial Sequence: Synthetic oligonucleotide
gggaggacgaugcggugacucgucuguucguccccagacgacucgcccga

SEQ ID NO: 8238 - RNA, 51 nt, Artificial Sequence
  Description of Artificial Sequence: Synthetic oligonucleotide
gggaggacgaugcggauuggugaaggaagguaccgcagacgacucgcccga

SEQ ID NO: 8239 - RNA, 51 nt, Artificial Sequence
  Description of Artificial Sequence: Synthetic oligonucleotide
gggaggacgaugcgguccugucguuuguucguccccagacgacucgcccga

SEQ ID NO: 8240 - RNA, 50 nt, Artificial Sequence
  Description of Artificial Sequence: Synthetic oligonucleotide
gggaggacgaugcgggccuuucgucuacccuccccagacgacucgcccga

SEQ ID NO: 8241 - RNA, 50 nt, Artificial Sequence
  Description of Artificial Sequence: Synthetic oligonucleotide
gggaggacgaugcggcggaaagguggagguggugcagacgacucgcccga

SEQ ID NO: 8242 - RNA, 51 nt, Artificial Sequence
  Description of Artificial Sequence: Synthetic oligonucleotide
gggaggacgaugcgguuugguggagggugguaccgcagacgacucgcccga

SEQ ID NO: 8243 - RNA, 51 nt, Artificial Sequence
  Description of Artificial Sequence: Synthetic oligonucleotide
gggaggacgaugcgguuugaagaaugauggguccgcagacgacucgcccga

SEQ ID NO: 8244 - RNA, 51 nt, Artificial Sequence
  Description of Artificial Sequence: Synthetic oligonucleotide
gggaggacgaugcgguuugaaggagggugggaccgcagacgacucgcccga

SEQ ID NO: 8245 - RNA, 51 nt, Artificial Sequence
  Description of Artificial Sequence: Synthetic oligonucleotide
gggaggacgaugcggauuggugaagggugggacugcagacgacucgcccga

SEQ ID NO: 8246 - RNA, 51 nt, Artificial Sequence
  Description of Artificial Sequence: Synthetic oligonucleotide
gggaggacgaugcggguugaagggugguggguccgcagacgacucgcccga

SEQ ID NO: 8247 - RNA, 51 nt, Artificial Sequence
  Description of Artificial Sequence: Synthetic oligonucleotide
gggaggacgaugcggcuuuuuacucuuuuuuuccgcagacgacucgcccga

SEQ ID NO: 8248 - RNA, 51 nt, Artificial Sequence
  Description of Artificial Sequence: Synthetic oligonucleotide
gggaggacgaugcggcagaggagaaggaagguugccagacgacucgcccga

SEQ ID NO: 8249 - RNA, 50 nt, Artificial Sequence
  Description of Artificial Sequence: Synthetic oligonucleotide
gggaggacgaugcgggccuuucuucugcccuccccagacgacucgcccga

SEQ ID NO: 8250 - RNA, 51 nt, Artificial Sequence
  Description of Artificial Sequence: Synthetic oligonucleotide
gggaggacgaugcggcagaggagaagggagguugucagacgacucgcccga

SEQ ID NO: 8251 - RNA, 50 nt, Artificial Sequence
  Description of Artificial Sequence: Synthetic oligonucleotide
gggaggacgaugcgggccuuucguucugcccuuccagacgacucgcccga

SEQ ID NO: 8252 - RNA, 51 nt, Artificial Sequence
  Description of Artificial Sequence: Synthetic oligonucleotide
gggaggacgaugcgguuaggguguagggugguccgcagacgacucgcccga

SEQ ID NO: 8253 - RNA, 51 nt, Artificial Sequence
  Description of Artificial Sequence: Synthetic oligonucleotide
gggaggacgaugcgguguuucgcucuccccgucugcagacgacucgcccga

SEQ ID NO: 8254 - RNA, 51 nt, Artificial Sequence
  Description of Artificial Sequence: Synthetic oligonucleotide
gggaggacgaugcggugacucgucugucucguccccagacgacucgcccga

SEQ ID NO: 8255 - RNA, 51 nt, Artificial Sequence
  Description of Artificial Sequence: Synthetic oligonucleotide
gggaggacgaugcgguauuggagguguggggaccgcagacgacucgcccga

SEQ ID NO: 8256 - RNA, 49 nt, Artificial Sequence
  Description of Artificial Sequence: Synthetic oligonucleotide
gggaggacgaugcggcgaagggugauggguccgcagacgacucgcccga

SEQ ID NO: 8257 - RNA, 50 nt, Artificial Sequence
  Description of Artificial Sequence: Synthetic oligonucleotide
gggaggacgaugcgguugaagggugguggguccgcagacgacucgcccga

SEQ ID NO: 8258 - RNA, 49 nt, Artificial Sequence
  Description of Artificial Sequence: Synthetic oligonucleotide
gggaggacgaugcgguuuagggugauggguccgcagacgacucgcccga

SEQ ID NO: 8259 - RNA, 50 nt, Artificial Sequence
  Description of Artificial Sequence: Synthetic oligonucleotide
gggaggacgaugcgguuggguguaggggguaccgcagacgacucgcccga

SEQ ID NO: 8260 - RNA, 51 nt, Artificial Sequence
  Description of Artificial Sequence: Synthetic oligonucleotide
gggaggacgaugcgguuugaaggaggauggguccgcagacgacucgcccga

SEQ ID NO: 8261 - RNA, 51 nt, Artificial Sequence
  Description of Artificial Sequence: Synthetic oligonucleotide
gggaggacgaugcgguuugaagggugggggguccgcagacgacucgcccga

SEQ ID NO: 8262 - RNA, 53 nt, Artificial Sequence
  Description of Artificial Sequence: Synthetic oligonucleotide
gggaggacgaugcgguguuugaagggugauggguccgcagacgacucgcccga

SEQ ID NO: 8263 - RNA, 51 nt, Artificial Sequence
  Description of Artificial Sequence: Synthetic oligonucleotide
gggaggacgaugcggguugaagggggauggguccgcagacgacucgcccga

SEQ ID NO: 8264 - RNA, 51 nt, Artificial Sequence
  Description of Artificial Sequence: Synthetic oligonucleotide
gggaggacgaugcggcagaggaguagggagguugccagacgacucgcccga

SEQ ID NO: 8265 - RNA, 51 nt, Artificial Sequence
  Description of Artificial Sequence: Synthetic oligonucleotide
gggaggacgaugcggaggcggcucgucuuauacugcagacgacucgcccga

SEQ ID NO: 8266 - RNA, 49 nt, Artificial Sequence
  Description of Artificial Sequence: Synthetic oligonucleotide
gggaggacgaugcggcuugucgucuugcguccccagacgacucgcccga

SEQ ID NO: 8267 - RNA, 52 nt, Artificial Sequence
  Description of Artificial Sequence: Synthetic oligonucleotide
gggaggacgaugcggguccugucgucuguucguccucagacgacucgcccga

SEQ ID NO: 8268 - RNA, 51 nt, Artificial Sequence
  Description of Artificial Sequence: Synthetic oligonucleotide
gggaggacgaugcgguuugaggggugguggguccgcagacgacucgcccga

SEQ ID NO: 8269 - RNA, 51 nt, Artificial Sequence
  Description of Artificial Sequence: Synthetic oligonucleotide
gggaggacgaugcggauuggugaagugagguaccgcagacgacucgcccga

SEQ ID NO: 8270 - RNA, 51 nt, Artificial Sequence
  Description of Artificial Sequence: Synthetic oligonucleotide
gggaggacgaugcggucugaagggugguggguccgcagacgacucgcccga

SEQ ID NO: 8271 - RNA, 51 nt, Artificial Sequence
  Description of Artificial Sequence: Synthetic oligonucleotide
gggaggacgaugcgguauuggagggguagggaccgcagacgacucgcccga

SEQ ID NO: 8272 - RNA, 50 nt, Artificial Sequence
  Description of Artificial Sequence: Synthetic oligonucleotide
gggaggacgaugcgggaugacggcgagugugcaccagacgacucgcccga

SEQ ID NO: 8273 - RNA, 51 nt, Artificial Sequence
  Description of Artificial Sequence: Synthetic oligonucleotide
gggaggacgaugcgggcucuucguucugcccuccccagacgacucgcccga

SEQ ID NO: 8274 - RNA, 50 nt, Artificial Sequence
  Description of Artificial Sequence: Synthetic oligonucleotide
gggaggacgaugcgguugggguuuucccgugccccagacgacucgcccga

SEQ ID NO: 8275 - RNA, 51 nt, Artificial Sequence
  Description of Artificial Sequence: Synthetic oligonucleotide
gggaggacgaugcgggccuaucguucugaccuccccagacgacucgcccga

SEQ ID NO: 8276 - RNA, 51 nt, Artificial Sequence
  Description of Artificial Sequence: Synthetic oligonucleotide
gggaggacgaugcgggguagggauggagguguucgcagacgacucgcccga

SEQ ID NO: 8277 - RNA, 51 nt, Artificial Sequence
  Description of Artificial Sequence: Synthetic oligonucleotide
gggaggacgaugcggauugguggagggagggacugcagacgacucgcccga

SEQ ID NO: 8278 - RNA, 51 nt, Artificial Sequence
  Description of Artificial Sequence: Synthetic oligonucleotide
gggaggacgaugcgguuuggugaagggagggacugcagacgacucgcccga

SEQ ID NO: 8279 - RNA, 50 nt, Artificial Sequence
  Description of Artificial Sequence: Synthetic oligonucleotide
gggaggacgaugcggauuggugagggagguacugcagacgacucgcccga

SEQ ID NO: 8280 - RNA, 51 nt, Artificial Sequence
  Description of Artificial Sequence: Synthetic oligonucleotide
gggaggacgaugcggauagggagaagggggaaccgcagacgacucgcccga

SEQ ID NO: 8281 - RNA, 52 nt, Artificial Sequence
  Description of Artificial Sequence: Synthetic oligonucleotide
gggaggacgaugcgguauugaagggugauggguccgcagacgacucgcccga

SEQ ID NO: 8282 - RNA, 51 nt, Artificial Sequence
  Description of Artificial Sequence: Synthetic oligonucleotide
gggaggacgaugcgguuuggagggcgauggguccgcagacgacucgcccga

SEQ ID NO: 8283 - RNA, 51 nt, Artificial Sequence
  Description of Artificial Sequence: Synthetic oligonucleotide
gggaggacgaugcgggccuuucguucugaccucgccagacgacucgcccga

SEQ ID NO: 8284 - RNA, 51 nt, Artificial Sequence
  Description of Artificial Sequence: Synthetic oligonucleotide
gggaggacgaugcgguuugggguuuucccgugucccagacgacucgcccga

SEQ ID NO: 8285 - RNA, 51 nt, Artificial Sequence
  Description of Artificial Sequence: Synthetic oligonucleotide
gggaggacgaugcgguccugucgucuguccguccccagacgacucgcccga

SEQ ID NO: 8286 - RNA, 51 nt, Artificial Sequence
  Description of Artificial Sequence: Synthetic oligonucleotide
gggaggacgaugcggucuuuccugucguacuggugcagacgacucgcccga

SEQ ID NO: 8287 - RNA, 51 nt, Artificial Sequence
  Description of Artificial Sequence: Synthetic oligonucleotide
gggaggacgaugcggccuccagaccuguuucuguccagacgacucgcccga

SEQ ID NO: 8288 - RNA, 51 nt, Artificial Sequence
  Description of Artificial Sequence: Synthetic oligonucleotide
gggaggacgaugcggugaaaguucucgucggcccccagacgacucgcccga

SEQ ID NO: 8289 - RNA, 51 nt, Artificial Sequence
  Description of Artificial Sequence: Synthetic oligonucleotide
gggaggacgaugcgggccugucguucugcccuccccagacgacucgcccga

SEQ ID NO: 8290 - RNA, 51 nt, Artificial Sequence
  Description of Artificial Sequence: Synthetic oligonucleotide
gggaggacgaugcgguuugaagggugguguguccgcagacgacucgcccga

SEQ ID NO: 8291 - RNA, 51 nt, Artificial Sequence
  Description of Artificial Sequence: Synthetic oligonucleotide
gggaggacgaugcgguuugaaggguaguggguccgcagacgacucgcccga

SEQ ID NO: 8292 - RNA, 51 nt, Artificial Sequence
  Description of Artificial Sequence: Synthetic oligonucleotide
gggaggacgaugcgguuggguguaggggguuaccgcagacgacucgcccga

SEQ ID NO: 8293 - RNA, 50 nt, Artificial Sequence
  Description of Artificial Sequence: Synthetic oligonucleotide
gggaggacgaugcgguuugaaggguguggguccgcagacgacucgcccga

SEQ ID NO: 8294 - RNA, 51 nt, Artificial Sequence
  Description of Artificial Sequence: Synthetic oligonucleotide
gggaggacgaugcgguuugaagguggauggguccgcagacgacucgcccga

SEQ ID NO: 8295 - RNA, 51 nt, Artificial Sequence
  Description of Artificial Sequence: Synthetic oligonucleotide
gggaggacgaugcgggacagucgucacuuccugcccagacgacucgcccga

SEQ ID NO: 8296 - RNA, 51 nt, Artificial Sequence
  Description of Artificial Sequence: Synthetic oligonucleotide
gggaggacgaugcgguuugggguuuuccugugccccagacgacucgcccga

SEQ ID NO: 8297 - RNA, 51 nt, Artificial Sequence
  Description of Artificial Sequence: Synthetic oligonucleotide
gggaggacgaugcggauuggugaagggagguaccacagacgacucgcccga

SEQ ID NO: 8298 - RNA, 51 nt, Artificial Sequence
  Description of Artificial Sequence: Synthetic oligonucleotide
gggaggacgaugcggaccuccucgaguugugucgccagacgacucgcccga

SEQ ID NO: 8299 - RNA, 51 nt, Artificial Sequence
  Description of Artificial Sequence: Synthetic oligonucleotide
gggaggacgaugcgguggacgaccgucuguaugugcagacgacucgcccga

SEQ ID NO: 8300 - RNA, 51 nt, Artificial Sequence
  Description of Artificial Sequence: Synthetic oligonucleotide
gggaggacgaugcggguccugucgucuguucgucccagacgacucgcccga

SEQ ID NO: 8301 - RNA, 51 nt, Artificial Sequence
  Description of Artificial Sequence: Synthetic oligonucleotide
gggaggacgaugcggucuccuguggcguugugcugcagacgacucgcccga

SEQ ID NO: 8302 - RNA, 51 nt, Artificial Sequence
  Description of Artificial Sequence: Synthetic oligonucleotide
gggaggacgaugcgguuggguguaggggggcaccgcagacgacucgcccga

SEQ ID NO: 8303 - RNA, 52 nt, Artificial Sequence
  Description of Artificial Sequence: Synthetic oligonucleotide
gggaggacgaugcggguuugaagggugauggguccgcagacgacucgcccga

SEQ ID NO: 8304 - RNA, 51 nt, Artificial Sequence
  Description of Artificial Sequence: Synthetic oligonucleotide
gggaggacgaugcgguuugaagggcgaugggaccgcagacgacucgcccga

SEQ ID NO: 8305 - RNA, 51 nt, Artificial Sequence
  Description of Artificial Sequence: Synthetic oligonucleotide
gggaggacgaugcgguuugaugggggauggguccgcagacgacucgcccga

SEQ ID NO: 8306 - RNA, 51 nt, Artificial Sequence
  Description of Artificial Sequence: Synthetic oligonucleotide
gggaggacgaugcggcagaggagaugggagguugccagacgacucgcccga

SEQ ID NO: 8307 - RNA, 51 nt, Artificial Sequence
  Description of Artificial Sequence: Synthetic oligonucleotide
gggaggacgaugcggauagggagaaggguguaccgcagacgacucgcccga

SEQ ID NO: 8308 - RNA, 51 nt, Artificial Sequence
  Description of Artificial Sequence: Synthetic oligonucleotide
gggaggacgaugcggugacucguuuguaucuuccccagacgacucgcccga

SEQ ID NO: 8309 - RNA, 51 nt, Artificial Sequence
  Description of Artificial Sequence: Synthetic oligonucleotide
gggaggacgaugcgguaaucguuuccuccuguguccagacgacucgcccga

SEQ ID NO: 8310 - RNA, 51 nt, Artificial Sequence
  Description of Artificial Sequence: Synthetic oligonucleotide
gggaggacgaugcgguguaggaggaggaaguaccgcagacgacucgcccga

SEQ ID NO: 8311 - RNA, 51 nt, Artificial Sequence
  Description of Artificial Sequence: Synthetic oligonucleotide
gggaggacgaugcggagugggagaaggguguuacgcagacgacucgcccga

SEQ ID NO: 8312 - RNA, 52 nt, Artificial Sequence
  Description of Artificial Sequence: Synthetic oligonucleotide
gggaggacgaugcggguuggguguagggugguaccgcagacgacucgcccga

SEQ ID NO: 8313 - RNA, 51 nt, Artificial Sequence
  Description of Artificial Sequence: Synthetic oligonucleotide
gggaggacgaugcgguuugaagggugaugaauccgcagacgacucgcccga

SEQ ID NO: 8314 - RNA, 51 nt, Artificial Sequence
  Description of Artificial Sequence: Synthetic oligonucleotide
gggaggacgaugcgggccuuucguucugcuuuccccagacgacucgcccga

SEQ ID NO: 8315 - RNA, 51 nt, Artificial Sequence
  Description of Artificial Sequence: Synthetic oligonucleotide
gggaggacgaugcgguuggggguagggagguaccgcagacgacucgcccga

SEQ ID NO: 8316 - RNA, 51 nt, Artificial Sequence
  Description of Artificial Sequence: Synthetic oligonucleotide
gggaggacgaugcgguuuggaggagggugguaccgcagacgacucgcccga

SEQ ID NO: 8317 - RNA, 51 nt, Artificial Sequence
  Description of Artificial Sequence: Synthetic oligonucleotide
gggaggacgaugcggcaaaggagaagggagguugccagacgacucgcccga

SEQ ID NO: 8318 - RNA, 51 nt, Artificial Sequence
  Description of Artificial Sequence: Synthetic oligonucleotide
gggaggacgaugcggcagaggagaagagagguugccagacgacucgcccga

SEQ ID NO: 8319 - RNA, 51 nt, Artificial Sequence
  Description of Artificial Sequence: Synthetic oligonucleotide
gggaggacgaugcggugggugaaggguguauagcgcagacgacucgcccga

SEQ ID NO: 8320 - RNA, 51 nt, Artificial Sequence
  Description of Artificial Sequence: Synthetic oligonucleotide
gggaggacgaugcgguuugaaggguggugguaccgcagacgacucgcccga

SEQ ID NO: 8321 - RNA, 51 nt, Artificial Sequence
  Description of Artificial Sequence: Synthetic oligonucleotide
gggaggacgaugcggucaucuuucucccauguggccagacgacucgcccga

SEQ ID NO: 8322 - RNA, 51 nt, Artificial Sequence
  Description of Artificial Sequence: Synthetic oligonucleotide
gggaggacgaugcggucgaucguuuuccgcgugugcagacgacucgcccga

SEQ ID NO: 8323 - RNA, 52 nt, Artificial Sequence
  Description of Artificial Sequence: Synthetic oligonucleotide
gggaggacgaugcgggccuuucguucugccccuccccagacgacucgcccga

SEQ ID NO: 8324 - RNA, 51 nt, Artificial Sequence
  Description of Artificial Sequence: Synthetic oligonucleotide
gggaggacgaugcgguccugacgucuguucguccccagacgacucgcccga

SEQ ID NO: 8325 - RNA, 51 nt, Artificial Sequence
  Description of Artificial Sequence: Synthetic oligonucleotide
gggaggacgaugcgguuggguguagggcgguacugcagacgacucgcccga

SEQ ID NO: 8326 - RNA, 51 nt, Artificial Sequence
  Description of Artificial Sequence: Synthetic oligonucleotide
gggaggacgaugcgguugggagggggaugggaccgcagacgacucgcccga

SEQ ID NO: 8327 - RNA, 51 nt, Artificial Sequence
  Description of Artificial Sequence: Synthetic oligonucleotide
gggaggacgaugcgguuggguguagggcggcaccgcagacgacucgcccga

SEQ ID NO: 8328 - RNA, 51 nt, Artificial Sequence
  Description of Artificial Sequence: Synthetic oligonucleotide
gggaggacgaugcgguuugaagggaguuggguccgcagacgacucgcccga

SEQ ID NO: 8329 - RNA, 51 nt, Artificial Sequence
  Description of Artificial Sequence: Synthetic oligonucleotide
gggaggacgaugcgguuggaagggggaugggaccgcagacgacucgcccga

SEQ ID NO: 8330 - RNA, 51 nt, Artificial Sequence
  Description of Artificial Sequence: Synthetic oligonucleotide
gggaggacgaugcgguuugcagggggauggguccgcagacgacucgcccga

SEQ ID NO: 8331 - RNA, 50 nt, Artificial Sequence
  Description of Artificial Sequence: Synthetic oligonucleotide
gggaggacgaugcgguauggagguguagggaccgcagacgacucgcccga

SEQ ID NO: 8332 - RNA, 51 nt, Artificial Sequence
  Description of Artificial Sequence: Synthetic oligonucleotide
gggaggacgaugcgguuuguagggcgauggguccgcagacgacucgcccga

SEQ ID NO: 8333 - RNA, 51 nt, Artificial Sequence
  Description of Artificial Sequence: Synthetic oligonucleotide
gggaggacgaugcgggccguucguucugaccuccccagacgacucgcccga

SEQ ID NO: 8334 - RNA, 51 nt, Artificial Sequence
  Description of Artificial Sequence: Synthetic oligonucleotide
gggaggacgaugcgguuugggguuuuccccugccccagacgacucgcccga

SEQ ID NO: 8335 - RNA, 51 nt, Artificial Sequence
  Description of Artificial Sequence: Synthetic oligonucleotide
gggaggacgaugcgguguaggaggaggagguaccccagacgacucgcccga

SEQ ID NO: 8336 - RNA, 51 nt, Artificial Sequence
  Description of Artificial Sequence: Synthetic oligonucleotide
gggaggacgaugcggugacucguuuguuucguccccagacgacucgcccga

SEQ ID NO: 8337 - RNA, 49 nt, Artificial Sequence
  Description of Artificial Sequence: Synthetic oligonucleotide
gggaggacgaugcggugugggucugguuguggccagacgacucgcccga

SEQ ID NO: 8338 - RNA, 49 nt, Artificial Sequence
  Description of Artificial Sequence: Synthetic oligonucleotide
gggaggacgaugcgggccuuucguucugcuccccagacgacucgcccga

SEQ ID NO: 8339 - RNA, 51 nt, Artificial Sequence
  Description of Artificial Sequence: Synthetic oligonucleotide
gggaggacgaugcgggccuuucguucugaccugcccagacgacucgcccga

SEQ ID NO: 8340 - RNA, 51 nt, Artificial Sequence
  Description of Artificial Sequence: Synthetic oligonucleotide
gggaggacgaugcgguuugaaggaugguggguccgcagacgacucgcccga

SEQ ID NO: 8341 - RNA, 51 nt, Artificial Sequence
  Description of Artificial Sequence: Synthetic oligonucleotide
gggaggacgaugcggguugguguagggugguaccgcagacgacucgcccga

SEQ ID NO: 8342 - RNA, 51 nt, Artificial Sequence
  Description of Artificial Sequence: Synthetic oligonucleotide
gggaggacgaugcgggccuuuccuucugcccuccccagacgacucgcccga

SEQ ID NO: 8343 - RNA, 51 nt, Artificial Sequence
  Description of Artificial Sequence: Synthetic oligonucleotide
gggaggacgaugcgguguaggaggaggagguaccacagacgacucgcccga

SEQ ID NO: 8344 - RNA, 51 nt, Artificial Sequence
  Description of Artificial Sequence: Synthetic oligonucleotide
gggaggacgaugcgguugggaggaggaugggaccgcagacgacucgcccga

SEQ ID NO: 8345 - RNA, 49 nt, Artificial Sequence
  Description of Artificial Sequence: Synthetic oligonucleotide
gggaggacgaugcgguaggaggaggagguaccgcagacgacucgcccga

SEQ ID NO: 8346 - RNA, 51 nt, Artificial Sequence
  Description of Artificial Sequence: Synthetic oligonucleotide
gggaggacgaugcgguuugaagggcgauugguccgcagacgacucgcccga

SEQ ID NO: 8347 - RNA, 51 nt, Artificial Sequence
  Description of Artificial Sequence: Synthetic oligonucleotide
gggaggacgaugcgguuugaagggcgauggggccgcagacgacucgcccga

SEQ ID NO: 8348 - RNA, 51 nt, Artificial Sequence
  Description of Artificial Sequence: Synthetic oligonucleotide
gggaggacgaugcggcagagaagaagggagguugccagacgacucgcccga

SEQ ID NO: 8349 - RNA, 51 nt, Artificial Sequence
  Description of Artificial Sequence: Synthetic oligonucleotide
gggaggacgaugcggaguaggugaaggguggcccgcagacgacucgcccga

SEQ ID NO: 8350 - RNA, 51 nt, Artificial Sequence
  Description of Artificial Sequence: Synthetic oligonucleotide
gggaggacgaugcggcagaggagaagugagguugccagacgacucgcccga

SEQ ID NO: 8351 - RNA, 51 nt, Artificial Sequence
  Description of Artificial Sequence: Synthetic oligonucleotide
gggaggacgaugcggcagaggagaauggagguugccagacgacucgcccga

SEQ ID NO: 8352 - RNA, 51 nt, Artificial Sequence
  Description of Artificial Sequence: Synthetic oligonucleotide
gggaggacgaugcggcuacuuuauccugcaagggccagacgacucgcccga

SEQ ID NO: 8353 - RNA, 51 nt, Artificial Sequence
  Description of Artificial Sequence: Synthetic oligonucleotide
gggaggacgaugcgggcgcaucguuuugacugcugcagacgacucgcccga

SEQ ID NO: 8354 - RNA, 50 nt, Artificial Sequence
  Description of Artificial Sequence: Synthetic oligonucleotide
gggaggacgaugcgguuggguguaggguguuccgcagacgacucgcccga

SEQ ID NO: 8355 - RNA, 51 nt, Artificial Sequence
  Description of Artificial Sequence: Synthetic oligonucleotide
gggaggacgaugcggcuugggguuuucccgugccccagacgacucgcccga

SEQ ID NO: 8356 - RNA, 51 nt, Artificial Sequence
  Description of Artificial Sequence: Synthetic oligonucleotide
gggaggacgaugcggauuggugaauggagguaccgcagacgacucgcccga

SEQ ID NO: 8357 - RNA, 51 nt, Artificial Sequence
  Description of Artificial Sequence: Synthetic oligonucleotide
gggaggacgaugcgggccauucguucugaccuccccagacgacucgcccga

SEQ ID NO: 8358 - RNA, 51 nt, Artificial Sequence
  Description of Artificial Sequence: Synthetic oligonucleotide
gggaggacgaugcgguccugucaucuguucguccccagacgacucgcccga

SEQ ID NO: 8359 - RNA, 51 nt, Artificial Sequence
  Description of Artificial Sequence: Synthetic oligonucleotide
gggaggacgaugcggcauuggagguguagggaccgcagacgacucgcccga

SEQ ID NO: 8360 - RNA, 51 nt, Artificial Sequence
  Description of Artificial Sequence: Synthetic oligonucleotide
gggaggacgaugcggggcuuucguucugcccuccccagacgacucgcccga

SEQ ID NO: 8361 - RNA, 51 nt, Artificial Sequence
  Description of Artificial Sequence: Synthetic oligonucleotide
gggaggacgaugcgguuugaagugggauggguccgcagacgacucgcccga

SEQ ID NO: 8362 - RNA, 51 nt, Artificial Sequence
  Description of Artificial Sequence: Synthetic oligonucleotide
gggaggacgaugcgguuugaagggugaugggacugcagacgacucgcccga

SEQ ID NO: 8363 - RNA, 51 nt, Artificial Sequence
  Description of Artificial Sequence: Synthetic oligonucleotide
gggaggacgaugcgguuugaagggggaugggacugcagacgacucgcccga

SEQ ID NO: 8364 - RNA, 51 nt, Artificial Sequence
  Description of Artificial Sequence: Synthetic oligonucleotide
gggaggacgaugcggggcagucuucucgaugugugcagacgacucgcccga

SEQ ID NO: 8365 - RNA, 51 nt, Artificial Sequence
  Description of Artificial Sequence: Synthetic oligonucleotide
gggaggacgaugcggugcguuucguuugcccugcccagacgacucgcccga

SEQ ID NO: 8366 - RNA, 51 nt, Artificial Sequence
  Description of Artificial Sequence: Synthetic oligonucleotide
gggaggacgaugcggauuggugaagggagguaccccagacgacucgcccga

SEQ ID NO: 8367 - RNA, 51 nt, Artificial Sequence
  Description of Artificial Sequence: Synthetic oligonucleotide
gggaggacgaugcgggauccguguccucuggugugcagacgacucgcccga

SEQ ID NO: 8368 - RNA, 52 nt, Artificial Sequence
  Description of Artificial Sequence: Synthetic oligonucleotide
gggaggacgaugcgggccuuucguucugcccuuccccagacgacucgcccga

SEQ ID NO: 8369 - RNA, 51 nt, Artificial Sequence
  Description of Artificial Sequence: Synthetic oligonucleotide
gggaggacgaugcggaacuaucauacauauggcugcagacgacucgcccga

SEQ ID NO: 8370 - RNA, 51 nt, Artificial Sequence
  Description of Artificial Sequence: Synthetic oligonucleotide
gggaggacgaugcggcguuucuucugguucguccccagacgacucgcccga

SEQ ID NO: 8371 - RNA, 51 nt, Artificial Sequence
  Description of Artificial Sequence: Synthetic oligonucleotide
gggaggacgaugcgguuugaagggugaugggggugcagacgacucgcccga

SEQ ID NO: 8372 - RNA, 51 nt, Artificial Sequence
  Description of Artificial Sequence: Synthetic oligonucleotide
gggaggacgaugcgguugggcguagggggguaccgcagacgacucgcccga

SEQ ID NO: 8373 - RNA, 51 nt, Artificial Sequence
  Description of Artificial Sequence: Synthetic oligonucleotide
gggaggacgaugcggcuugaagggcgauggguccgcagacgacucgcccga

SEQ ID NO: 8374 - RNA, 51 nt, Artificial Sequence
  Description of Artificial Sequence: Synthetic oligonucleotide
gggaggacgaugcggcagaggaaaagggagguugccagacgacucgcccga

SEQ ID NO: 8375 - RNA, 51 nt, Artificial Sequence
  Description of Artificial Sequence: Synthetic oligonucleotide
gggaggacgaugcgggccuucuggcuuaucguccccagacgacucgcccga

SEQ ID NO: 8376 - RNA, 51 nt, Artificial Sequence
  Description of Artificial Sequence: Synthetic oligonucleotide
gggaggacgaugcggugggccuucgucuugcugugcagacgacucgcccga

SEQ ID NO: 8377 - RNA, 51 nt, Artificial Sequence
  Description of Artificial Sequence: Synthetic oligonucleotide
gggaggacgaugcgggccuuucguugugaccuccccagacgacucgcccga

SEQ ID NO: 8378 - RNA, 51 nt, Artificial Sequence
  Description of Artificial Sequence: Synthetic oligonucleotide
gggaggacgaugcggugagucagucuuuaccgccccagacgacucgcccga

SEQ ID NO: 8379 - RNA, 50 nt, Artificial Sequence
  Description of Artificial Sequence: Synthetic oligonucleotide
gggaggacgaugcggcguuuccucugguuguccccagacgacucgcccga

SEQ ID NO: 8380 - RNA, 51 nt, Artificial Sequence
  Description of Artificial Sequence: Synthetic oligonucleotide
gggaggacgaugcggauuggugaagggagcuaccgcagacgacucgcccga

SEQ ID NO: 8381 - RNA, 51 nt, Artificial Sequence
  Description of Artificial Sequence: Synthetic oligonucleotide
gggaggacgaugcgguugauucgucugugcucccccagacgacucgcccga

SEQ ID NO: 8382 - RNA, 51 nt, Artificial Sequence
  Description of Artificial Sequence: Synthetic oligonucleotide
gggaggacgaugcgguguaggaggaggagcuaccgcagacgacucgcccga

SEQ ID NO: 8383 - RNA, 51 nt, Artificial Sequence
  Description of Artificial Sequence: Synthetic oligonucleotide
gggaggacgaugcggcagaggagcagggagguugccagacgacucgcccga

SEQ ID NO: 8384 - RNA, 51 nt, Artificial Sequence
  Description of Artificial Sequence: Synthetic oligonucleotide
gggaggacgaugcggauuggugaagggagauaccgcagacgacucgcccga

SEQ ID NO: 8385 - RNA, 51 nt, Artificial Sequence
  Description of Artificial Sequence: Synthetic oligonucleotide
gggaggacgaugcgggccuuucgugcugcccuccccagacgacucgcccga

SEQ ID NO: 8386 - RNA, 49 nt, Artificial Sequence
  Description of Artificial Sequence: Synthetic oligonucleotide
gggaggacgaugcgguuugaagggugaugggagcagacgacucgcccga

SEQ ID NO: 8387 - RNA, 51 nt, Artificial Sequence
  Description of Artificial Sequence: Synthetic oligonucleotide
gggaggacgaugcgguugggaguagggggguaccgcagacgacucgcccga

SEQ ID NO: 8388 - RNA, 51 nt, Artificial Sequence
  Description of Artificial Sequence: Synthetic oligonucleotide
gggaggacgaugcgguuuggagggagauggguccgcagacgacucgcccga

SEQ ID NO: 8389 - RNA, 51 nt, Artificial Sequence
  Description of Artificial Sequence: Synthetic oligonucleotide
gggaggacgaugcgguuugaggggggauggguccgcagacgacucgcccga

SEQ ID NO: 8390 - RNA, 51 nt, Artificial Sequence
  Description of Artificial Sequence: Synthetic oligonucleotide
gggaggacgaugcgguuaaggaggagauggaggugcagacgacucgcccga

SEQ ID NO: 8391 - RNA, 51 nt, Artificial Sequence
  Description of Artificial Sequence: Synthetic oligonucleotide
gggaggacgaugcggcagaggagaaaggagguugccagacgacucgcccga

SEQ ID NO: 8392 - RNA, 50 nt, Artificial Sequence
  Description of Artificial Sequence: Synthetic oligonucleotide
gggaggacgaugcggucugucgucuguucguccccagacgacucgcccga

SEQ ID NO: 8393 - RNA, 51 nt, Artificial Sequence
  Description of Artificial Sequence: Synthetic oligonucleotide
gggaggacgaugcggaauuuugguggagguggaugcagacgacucgcccga

SEQ ID NO: 8394 - RNA, 51 nt, Artificial Sequence
  Description of Artificial Sequence: Synthetic oligonucleotide
gggaggacgaugcggauugguuaagggagguaccgcagacgacucgcccga

SEQ ID NO: 8395 - RNA, 52 nt, Artificial Sequence
  Description of Artificial Sequence: Synthetic oligonucleotide
gggaggacgaugcgggccuuucguucugcccucccccagacgacucgcccga

SEQ ID NO: 8396 - RNA, 50 nt, Artificial Sequence
  Description of Artificial Sequence: Synthetic oligonucleotide
gggaggacgaugcgguccuugucgucuugcgucccagacgacucgcccga

SEQ ID NO: 8397 - RNA, 51 nt, Artificial Sequence
  Description of Artificial Sequence: Synthetic oligonucleotide
gggaggacgaugcggucuguacgguggugagggggcagacgacucgcccga

SEQ ID NO: 8398 - RNA, 51 nt, Artificial Sequence
  Description of Artificial Sequence: Synthetic oligonucleotide
gggaggacgaugcgguguagggagguagucaucgucagacgacucgcccga

SEQ ID NO: 8399 - RNA, 51 nt, Artificial Sequence
  Description of Artificial Sequence: Synthetic oligonucleotide
gggaggacgaugcgguaggaggaggagguguugugcagacgacucgcccga

SEQ ID NO: 8400 - RNA, 51 nt, Artificial Sequence
  Description of Artificial Sequence: Synthetic oligonucleotide
gggaggacgaugcgguuugaugggcgauggguccgcagacgacucgcccga

SEQ ID NO: 8401 - RNA, 51 nt, Artificial Sequence
  Description of Artificial Sequence: Synthetic oligonucleotide
gggaggacgaugcggaggcgucucgucuuauacugcagacgacucgcccga

SEQ ID NO: 8402 - RNA, 51 nt, Artificial Sequence
  Description of Artificial Sequence: Synthetic oligonucleotide
gggaggacgaugcggcagaggcgaagggagguugccagacgacucgcccga

SEQ ID NO: 8403 - RNA, 51 nt, Artificial Sequence
  Description of Artificial Sequence: Synthetic oligonucleotide
gggaggacgaugcgguuugucgucuuguucguccccagacgacucgcccga

SEQ ID NO: 8404 - RNA, 51 nt, Artificial Sequence
  Description of Artificial Sequence: Synthetic oligonucleotide
gggaggacgaugcgguuggacuuggaaaccguggccagacgacucgcccga

SEQ ID NO: 8405 - RNA, 51 nt, Artificial Sequence
  Description of Artificial Sequence: Synthetic oligonucleotide
gggaggacgaugcgggguggugaaggguugguccgcagacgacucgcccga

SEQ ID NO: 8406 - RNA, 51 nt, Artificial Sequence
  Description of Artificial Sequence: Synthetic oligonucleotide
gggaggacgaugcgguauaauuaggaggaggugggcagacgacucgcccga

SEQ ID NO: 8407 - RNA, 51 nt, Artificial Sequence
  Description of Artificial Sequence: Synthetic oligonucleotide
gggaggacgaugcggagggagcagggaguuuaccgcagacgacucgcccga

SEQ ID NO: 8408 - RNA, 51 nt, Artificial Sequence
  Description of Artificial Sequence: Synthetic oligonucleotide
gggaggacgaugcggucggguccucgcauugugugcagacgacucgcccga

SEQ ID NO: 8409 - RNA, 51 nt, Artificial Sequence
  Description of Artificial Sequence: Synthetic oligonucleotide
gggaggacgaugcgggccuuucguucugaccgccccagacgacucgcccga

SEQ ID NO: 8410 - RNA, 51 nt, Artificial Sequence
  Description of Artificial Sequence: Synthetic oligonucleotide
gggaggacgaugcggauuggugaagguagguaccgcagacgacucgcccga

SEQ ID NO: 8411 - RNA, 51 nt, Artificial Sequence
  Description of Artificial Sequence: Synthetic oligonucleotide
gggaggacgaugcgguuggguguacggugguaccgcagacgacucgcccga

SEQ ID NO: 8412 - RNA, 51 nt, Artificial Sequence
  Description of Artificial Sequence: Synthetic oligonucleotide
gggaggacgaugcgguuugaagggagauggguccccagacgacucgcccga

SEQ ID NO: 8413 - RNA, 51 nt, Artificial Sequence
  Description of Artificial Sequence: Synthetic oligonucleotide
gggaggacgaugcgguguaggaggcggagguaccgcagacgacucgcccga

SEQ ID NO: 8414 - RNA, 51 nt, Artificial Sequence
  Description of Artificial Sequence: Synthetic oligonucleotide
gggaggacgaugcgguuuaggaggaggagguaccgcagacgacucgcccga

SEQ ID NO: 8415 - RNA, 51 nt, Artificial Sequence
  Description of Artificial Sequence: Synthetic oligonucleotide
gggaggacgaugcgguuugaagggcguuggguccgcagacgacucgcccga

SEQ ID NO: 8416 - RNA, 51 nt, Artificial Sequence
  Description of Artificial Sequence: Synthetic oligonucleotide
gggaggacgaugcgguucguuuccuucgucgugugcagacgacucgcccga

SEQ ID NO: 8417 - RNA, 51 nt, Artificial Sequence
  Description of Artificial Sequence: Synthetic oligonucleotide
gggaggacgaugcggccaagucguuccaucgugugcagacgacucgcccga

SEQ ID NO: 8418 - RNA, 51 nt, Artificial Sequence
  Description of Artificial Sequence: Synthetic oligonucleotide
gggaggacgaugcggugccucugucguugcuugugcagacgacucgcccga

SEQ ID NO: 8419 - RNA, 51 nt, Artificial Sequence
  Description of Artificial Sequence: Synthetic oligonucleotide
gggaggacgaugcgguguaggaagaggagguaccgcagacgacucgcccga

SEQ ID NO: 8420 - RNA, 51 nt, Artificial Sequence
  Description of Artificial Sequence: Synthetic oligonucleotide
gggaggacgaugcggucuggugauguuagccggugcagacgacucgcccga

SEQ ID NO: 8421 - RNA, 51 nt, Artificial Sequence
  Description of Artificial Sequence: Synthetic oligonucleotide
gggaggacgaugcgggaugacggcgacucgcacuacagacgacucgcccga

SEQ ID NO: 8422 - RNA, 51 nt, Artificial Sequence
  Description of Artificial Sequence: Synthetic oligonucleotide
gggaggacgaugcggcgacuuuuugccucuuggcccagacgacucgcccga

SEQ ID NO: 8423 - RNA, 50 nt, Artificial Sequence
  Description of Artificial Sequence: Synthetic oligonucleotide
gggaggacgaugcggcagaggagaagggaggugccagacgacucgcccga

SEQ ID NO: 8424 - RNA, 51 nt, Artificial Sequence
  Description of Artificial Sequence: Synthetic oligonucleotide
gggaggacgaugcggcagaggagaagggagguuggcagacgacucgcccga

SEQ ID NO: 8425 - RNA, 51 nt, Artificial Sequence
  Description of Artificial Sequence: Synthetic oligonucleotide
gggaggacgaugcggcuuggugaagggagguaccgcagacgacucgcccga

SEQ ID NO: 8426 - RNA, 51 nt, Artificial Sequence
  Description of Artificial Sequence: Synthetic oligonucleotide
gggaggacgaugcggguugcuguagugcggugcgccagacgacucgcccga

SEQ ID NO: 8427 - RNA, 51 nt, Artificial Sequence
  Description of Artificial Sequence: Synthetic oligonucleotide
gggaggacgaugcgguauuggagguguagugaccgcagacgacucgcccga

SEQ ID NO: 8428 - RNA, 51 nt, Artificial Sequence
  Description of Artificial Sequence: Synthetic oligonucleotide
gggaggacgaugcgguuugaagggcgauggguccccagacgacucgcccga

SEQ ID NO: 8429 - RNA, 49 nt, Artificial Sequence
  Description of Artificial Sequence: Synthetic oligonucleotide
gggaggacgaugcgguuugaagggguggguccgcagacgacucgcccga

SEQ ID NO: 8430 - RNA, 51 nt, Artificial Sequence
  Description of Artificial Sequence: Synthetic oligonucleotide
gggaggacgaugcgguguaggcggaggagguaccgcagacgacucgcccga

SEQ ID NO: 8431 - RNA, 51 nt, Artificial Sequence
  Description of Artificial Sequence: Synthetic oligonucleotide
gggaggacgaugcgguuugaagagggauggguccgcagacgacucgcccga

SEQ ID NO: 8432 - RNA, 51 nt, Artificial Sequence
  Description of Artificial Sequence: Synthetic oligonucleotide
gggaggacgaugcgguuuguugggugauggguccgcagacgacucgcccga

SEQ ID NO: 8433 - RNA, 51 nt, Artificial Sequence
  Description of Artificial Sequence: Synthetic oligonucleotide
gggaggacgaugcgguuggguguagggugguagcgcagacgacucgcccga

SEQ ID NO: 8434 - RNA, 51 nt, Artificial Sequence
  Description of Artificial Sequence: Synthetic oligonucleotide
gggaggacgaugcggaaucgggccuuuugucacugcagacgacucgcccga

SEQ ID NO: 8435 - RNA, 51 nt, Artificial Sequence
  Description of Artificial Sequence: Synthetic oligonucleotide
gggaggacgaugcgggccuuucgucuguucguccccagacgacucgcccga

SEQ ID NO: 8436 - RNA, 51 nt, Artificial Sequence
  Description of Artificial Sequence: Synthetic oligonucleotide
gggaggacgaugcggugaguaagucuguuuccccccagacgacucgcccga

SEQ ID NO: 8437 - RNA, 51 nt, Artificial Sequence
  Description of Artificial Sequence: Synthetic oligonucleotide
gggaggacgaugcgguguggcaaaauuacgcugugcagacgacucgcccga

SEQ ID NO: 8438 - RNA, 51 nt, Artificial Sequence
  Description of Artificial Sequence: Synthetic oligonucleotide
gggaggacgaugcggugacaguugucugcgcuccacagacgacucgcccga

SEQ ID NO: 8439 - RNA, 51 nt, Artificial Sequence
  Description of Artificial Sequence: Synthetic oligonucleotide
gggaggacgaugcggcagaggagaagggcgguugccagacgacucgcccga

SEQ ID NO: 8440 - RNA, 51 nt, Artificial Sequence
  Description of Artificial Sequence: Synthetic oligonucleotide
gggaggacgaugcgguccugucgucuauucguccccagacgacucgcccga

SEQ ID NO: 8441 - RNA, 51 nt, Artificial Sequence
  Description of Artificial Sequence: Synthetic oligonucleotide
gggaggacgaugcggccaacaaaucaugugugccccagacgacucgcccga

SEQ ID NO: 8442 - RNA, 51 nt, Artificial Sequence
  Description of Artificial Sequence: Synthetic oligonucleotide
gggaggacgaugcggaauuuguccucggucgugugcagacgacucgcccga

SEQ ID NO: 8443 - RNA, 51 nt, Artificial Sequence
  Description of Artificial Sequence: Synthetic oligonucleotide
gggaggacgaugcggauguguccuuaccagugccccagacgacucgcccga

SEQ ID NO: 8444 - RNA, 51 nt, Artificial Sequence
  Description of Artificial Sequence: Synthetic oligonucleotide
gggaggacgaugcggccauugaaccucccguuggccagacgacucgcccga

SEQ ID NO: 8445 - RNA, 51 nt, Artificial Sequence
  Description of Artificial Sequence: Synthetic oligonucleotide
gggaggacgaugcggucgaucguucuugccuacgccagacgacucgcccga

SEQ ID NO: 8446 - RNA, 51 nt, Artificial Sequence
  Description of Artificial Sequence: Synthetic oligonucleotide
gggaggacgaugcggaccuccaguugucuguacgccagacgacucgcccga

SEQ ID NO: 8447 - RNA, 51 nt, Artificial Sequence
  Description of Artificial Sequence: Synthetic oligonucleotide
gggaggacgaugcgguuggguguaggguguuacugcagacgacucgcccga

SEQ ID NO: 8448 - RNA, 51 nt, Artificial Sequence
  Description of Artificial Sequence: Synthetic oligonucleotide
gggaggacgaugcgguuggguguagggggguacugcagacgacucgcccga

SEQ ID NO: 8449 - RNA, 51 nt, Artificial Sequence
  Description of Artificial Sequence: Synthetic oligonucleotide
gggaggacgaugcggaacgugucgcuuugcugccccagacgacucgcccga

SEQ ID NO: 8450 - RNA, 51 nt, Artificial Sequence
  Description of Artificial Sequence: Synthetic oligonucleotide
gggaggacgaugcgguguggcgugucaucuccgugcagacgacucgcccga

SEQ ID NO: 8451 - RNA, 51 nt, Artificial Sequence
  Description of Artificial Sequence: Synthetic oligonucleotide
gggaggacgaugcgguugggaguaggguguuaccgcagacgacucgcccga

SEQ ID NO: 8452 - RNA, 51 nt, Artificial Sequence
  Description of Artificial Sequence: Synthetic oligonucleotide
gggaggacgaugcgguguaggagaaggagguaccgcagacgacucgcccga

SEQ ID NO: 8453 - RNA, 51 nt, Artificial Sequence
  Description of Artificial Sequence: Synthetic oligonucleotide
gggaggacgaugcgguuggguguagggaguuaccgcagacgacucgcccga

SEQ ID NO: 8454 - RNA, 51 nt, Artificial Sequence
  Description of Artificial Sequence: Synthetic oligonucleotide
gggaggacgaugcgguguaggaggaggagguacggcagacgacucgcccga

SEQ ID NO: 8455 - RNA, 50 nt, Artificial Sequence
  Description of Artificial Sequence: Synthetic oligonucleotide
gggaggacgaugcggcuugucgucuuguuguccccagacgacucgcccga

SEQ ID NO: 8456 - RNA, 51 nt, Artificial Sequence
  Description of Artificial Sequence: Synthetic oligonucleotide
gggaggacgaugcgguguagguggaggagguaccgcagacgacucgcccga

SEQ ID NO: 8457 - RNA, 51 nt, Artificial Sequence
  Description of Artificial Sequence: Synthetic oligonucleotide
gggaggacgaugcgguuuggaggaggauggguccgcagacgacucgcccga

SEQ ID NO: 8458 - RNA, 51 nt, Artificial Sequence
  Description of Artificial Sequence: Synthetic oligonucleotide
gggaggacgaugcgguguaguaggaggagguaccgcagacgacucgcccga

SEQ ID NO: 8459 - RNA, 51 nt, Artificial Sequence
  Description of Artificial Sequence: Synthetic oligonucleotide
gggaggacgaugcggggauagucugguuugcccgccagacgacucgcccga

SEQ ID NO: 8460 - RNA, 51 nt, Artificial Sequence
  Description of Artificial Sequence: Synthetic oligonucleotide
gggaggacgaugcggcagaggagaagguagguugccagacgacucgcccga

SEQ ID NO: 8461 - RNA, 51 nt, Artificial Sequence
  Description of Artificial Sequence: Synthetic oligonucleotide
gggaggacgaugcggcgucccuucgucuugugcgccagacgacucgcccga

SEQ ID NO: 8462 - RNA, 51 nt, Artificial Sequence
  Description of Artificial Sequence: Synthetic oligonucleotide
gggaggacgaugcgguuggguguaggguggugcugcagacgacucgcccga

SEQ ID NO: 8463 - RNA, 51 nt, Artificial Sequence
  Description of Artificial Sequence: Synthetic oligonucleotide
gggaggacgaugcgggcaauuucgucuaguguccccagacgacucgcccga

SEQ ID NO: 8464 - RNA, 51 nt, Artificial Sequence
  Description of Artificial Sequence: Synthetic oligonucleotide
gggaggacgaugcggaugucaacuacccgugaccgcagacgacucgcccga

SEQ ID NO: 8465 - RNA, 51 nt, Artificial Sequence
  Description of Artificial Sequence: Synthetic oligonucleotide
gggaggacgaugcgggccuuucguucugcccccuccagacgacucgcccga

SEQ ID NO: 8466 - RNA, 50 nt, Artificial Sequence
  Description of Artificial Sequence: Synthetic oligonucleotide
gggaggacgaugcggccguacguugucuccugugcagacgacucgcccga

SEQ ID NO: 8467 - RNA, 51 nt, Artificial Sequence
  Description of Artificial Sequence: Synthetic oligonucleotide
gggaggacgaugcgguccaucacacuaagccgcaccagacgacucgcccga

SEQ ID NO: 8468 - RNA, 51 nt, Artificial Sequence
  Description of Artificial Sequence: Synthetic oligonucleotide
gggaggacgaugcggugagucagaaucugcugccccagacgacucgcccga

SEQ ID NO: 8469 - RNA, 53 nt, Artificial Sequence
  Description of Artificial Sequence: Synthetic oligonucleotide
gggaggacgaugcgguuuuugguuuuuuuuuugcccgcagacgacucgcccga

SEQ ID NO: 8470 - RNA, 51 nt, Artificial Sequence
  Description of Artificial Sequence: Synthetic oligonucleotide
gggaggacgaugcggugacucgucuguuuuguccccagacgacucgcccga

SEQ ID NO: 8471 - RNA, 51 nt, Artificial Sequence
  Description of Artificial Sequence: Synthetic oligonucleotide
gggaggacgaugcgggccuuucguucggaccuccccagacgacucgcccga

SEQ ID NO: 8472 - RNA, 51 nt, Artificial Sequence
  Description of Artificial Sequence: Synthetic oligonucleotide
gggaggacgaugcgggguaggaggaggagguaccgcagacgacucgcccga

SEQ ID NO: 8473 - RNA, 51 nt, Artificial Sequence
  Description of Artificial Sequence: Synthetic oligonucleotide
gggaggacgaugcgguauaggaggaggagguaccgcagacgacucgcccga

SEQ ID NO: 8474 - RNA, 51 nt, Artificial Sequence
  Description of Artificial Sequence: Synthetic oligonucleotide
gggaggacgaugcgguaucggagguguagggaccgcagacgacucgcccga

SEQ ID NO: 8475 - RNA, 51 nt, Artificial Sequence
  Description of Artificial Sequence: Synthetic oligonucleotide
gggaggacgaugcggauugaagggggauggguccgcagacgacucgcccga

SEQ ID NO: 8476 - RNA, 51 nt, Artificial Sequence
  Description of Artificial Sequence: Synthetic oligonucleotide
gggaggacgaugcgguuuguagggagauggguccgcagacgacucgcccga

SEQ ID NO: 8477 - RNA, 51 nt, Artificial Sequence
  Description of Artificial Sequence: Synthetic oligonucleotide
gggaggacgaugcgguuugaggggcgauggguccgcagacgacucgcccga

SEQ ID NO: 8478 - RNA, 50 nt, Artificial Sequence
  Description of Artificial Sequence: Synthetic oligonucleotide
gggaggacgaugcggauuggugaagggagguacucagacgacucgcccga

SEQ ID NO: 8479 - RNA, 51 nt, Artificial Sequence
  Description of Artificial Sequence: Synthetic oligonucleotide
gggaggacgaugcgguuggguguagggugguauugcagacgacucgcccga

SEQ ID NO: 8480 - RNA, 51 nt, Artificial Sequence
  Description of Artificial Sequence: Synthetic oligonucleotide
gggaggacgaugcgguuggguguagggcggaaccgcagacgacucgcccga

SEQ ID NO: 8481 - RNA, 51 nt, Artificial Sequence
  Description of Artificial Sequence: Synthetic oligonucleotide
gggaggacgaugcgguuugaagggugguagguccgcagacgacucgcccga

SEQ ID NO: 8482 - RNA, 51 nt, Artificial Sequence
  Description of Artificial Sequence: Synthetic oligonucleotide
gggaggacgaugcggcuugaagggugauggggccgcagacgacucgcccga

SEQ ID NO: 8483 - RNA, 51 nt, Artificial Sequence
  Description of Artificial Sequence: Synthetic oligonucleotide
gggaggacgaugcggauugguguaggguguuaccgcagacgacucgcccga

SEQ ID NO: 8484 - RNA, 51 nt, Artificial Sequence
  Description of Artificial Sequence: Synthetic oligonucleotide
gggaggacgaugcggcagaggagaagggauguugccagacgacucgcccga

SEQ ID NO: 8485 - RNA, 51 nt, Artificial Sequence
  Description of Artificial Sequence: Synthetic oligonucleotide
gggaggacgaugcgguccgcucgcacauucgucugcagacgacucgcccga

SEQ ID NO: 8486 - RNA, 51 nt, Artificial Sequence
  Description of Artificial Sequence: Synthetic oligonucleotide
gggaggacgaugcgguugggcguaggguguuaccgcagacgacucgcccga

SEQ ID NO: 8487 - RNA, 51 nt, Artificial Sequence
  Description of Artificial Sequence: Synthetic oligonucleotide
gggaggacgaugcggcuggguguaggguguuaccgcagacgacucgcccga

SEQ ID NO: 8488 - RNA, 51 nt, Artificial Sequence
  Description of Artificial Sequence: Synthetic oligonucleotide
gggaggacgaugcgguuugggguucucccgugccccagacgacucgcccga

SEQ ID NO: 8489 - RNA, 51 nt, Artificial Sequence
  Description of Artificial Sequence: Synthetic oligonucleotide
gggaggacgaugcgguguaggaggaagagguaccgcagacgacucgcccga

SEQ ID NO: 8490 - RNA, 51 nt, Artificial Sequence
  Description of Artificial Sequence: Synthetic oligonucleotide
gggaggacgaugcgggucgucaguuuuccgcuccccagacgacucgcccga

SEQ ID NO: 8491 - RNA, 51 nt, Artificial Sequence
  Description of Artificial Sequence: Synthetic oligonucleotide
gggaggacgaugcggagugcgauggucugugugugcagacgacucgcccga

SEQ ID NO: 8492 - RNA, 52 nt, Artificial Sequence
  Description of Artificial Sequence: Synthetic oligonucleotide
gggaggacgaugcggauuggguguagggugguaccgcagacgacucgcccga

SEQ ID NO: 8493 - RNA, 51 nt, Artificial Sequence
  Description of Artificial Sequence: Synthetic oligonucleotide
gggaggacgaugcgguguaggaggaggagauaccgcagacgacucgcccga

SEQ ID NO: 8494 - RNA, 50 nt, Artificial Sequence
  Description of Artificial Sequence: Synthetic oligonucleotide
gggaggacgaugcggaucguccguucgucugccccagacgacucgcccga

SEQ ID NO: 8495 - RNA, 50 nt, Artificial Sequence
  Description of Artificial Sequence: Synthetic oligonucleotide
gggaggacgaugcggugacucgucuguuucgucccagacgacucgcccga

SEQ ID NO: 8496 - RNA, 51 nt, Artificial Sequence
  Description of Artificial Sequence: Synthetic oligonucleotide
gggaggacgaugcggauuugugaagggagguaccgcagacgacucgcccga

SEQ ID NO: 8497 - RNA, 51 nt, Artificial Sequence
  Description of Artificial Sequence: Synthetic oligonucleotide
gggaggacgaugcggccugucgucuuguucguccccagacgacucgcccga

SEQ ID NO: 8498 - RNA, 51 nt, Artificial Sequence
  Description of Artificial Sequence: Synthetic oligonucleotide
gggaggacgaugcgguccugucgucugaucguccccagacgacucgcccga

SEQ ID NO: 8499 - RNA, 52 nt, Artificial Sequence
  Description of Artificial Sequence: Synthetic oligonucleotide
gggaggacgaugcgguuuugaagggugguggguccgcagacgacucgcccga

SEQ ID NO: 8500 - RNA, 51 nt, Artificial Sequence
  Description of Artificial Sequence: Synthetic oligonucleotide
gggaggacgaugcgguuuggaggguggugggaccgcagacgacucgcccga

SEQ ID NO: 8501 - RNA, 51 nt, Artificial Sequence
  Description of Artificial Sequence: Synthetic oligonucleotide
gggaggacgaugcgguugggaguaggaugggaccgcagacgacucgcccga

SEQ ID NO: 8502 - RNA, 51 nt, Artificial Sequence
  Description of Artificial Sequence: Synthetic oligonucleotide
gggaggacgaugcgguuggguguagggaggaaccgcagacgacucgcccga

SEQ ID NO: 8503 - RNA, 51 nt, Artificial Sequence
  Description of Artificial Sequence: Synthetic oligonucleotide
gggaggacgaugcgguauuggaggugaagggaccgcagacgacucgcccga

SEQ ID NO: 8504 - RNA, 49 nt, Artificial Sequence
  Description of Artificial Sequence: Synthetic oligonucleotide
gggaggacgaugcggggguguagggugguaccgcagacgacucgcccga

SEQ ID NO: 8505 - RNA, 53 nt, Artificial Sequence
  Description of Artificial Sequence: Synthetic oligonucleotide
gggaggacgaugcggcuauuggugaagggagguacugcagacgacucgcccga

SEQ ID NO: 8506 - RNA, 51 nt, Artificial Sequence
  Description of Artificial Sequence: Synthetic oligonucleotide
gggaggacgaugcggguugguccguccugcgugugcagacgacucgcccga

SEQ ID NO: 8507 - RNA, 51 nt, Artificial Sequence
  Description of Artificial Sequence: Synthetic oligonucleotide
gggaggacgaugcggaguccugucguuuguggcgccagacgacucgcccga

SEQ ID NO: 8508 - RNA, 51 nt, Artificial Sequence
  Description of Artificial Sequence: Synthetic oligonucleotide
gggaggacgaugcggcagaggagaagggaggucgccagacgacucgcccga

SEQ ID NO: 8509 - RNA, 51 nt, Artificial Sequence
  Description of Artificial Sequence: Synthetic oligonucleotide
gggaggacgaugcggguccugucgucuguuguccccagacgacucgcccga

SEQ ID NO: 8510 - RNA, 51 nt, Artificial Sequence
  Description of Artificial Sequence: Synthetic oligonucleotide
gggaggacgaugcggguugagccuucuucguugugcagacgacucgcccga

SEQ ID NO: 8511 - RNA, 52 nt, Artificial Sequence
  Description of Artificial Sequence: Synthetic oligonucleotide
gggaggacgaugcgggccuuucguucugcccuaccccagacgacucgcccga

SEQ ID NO: 8512 - RNA, 51 nt, Artificial Sequence
  Description of Artificial Sequence: Synthetic oligonucleotide
gggaggacgaugcgguaccgcgucguuugcugcggcagacgacucgcccga

SEQ ID NO: 8513 - RNA, 50 nt, Artificial Sequence
  Description of Artificial Sequence: Synthetic oligonucleotide
gggaggacgaugcgguccugucgucugcuguccccagacgacucgcccga

SEQ ID NO: 8514 - RNA, 50 nt, Artificial Sequence
  Description of Artificial Sequence: Synthetic oligonucleotide
gggaggacgaugcgggccuuucguucgaccuccccagacgacucgcccga

SEQ ID NO: 8515 - RNA, 51 nt, Artificial Sequence
  Description of Artificial Sequence: Synthetic oligonucleotide
gggaggacgaugcgggcucuucguucugaccuccccagacgacucgcccga

SEQ ID NO: 8516 - RNA, 51 nt, Artificial Sequence
  Description of Artificial Sequence: Synthetic oligonucleotide
gggaggacgaugcggcagaggagaagggagguugacagacgacucgcccga

SEQ ID NO: 8517 - RNA, 51 nt, Artificial Sequence
  Description of Artificial Sequence: Synthetic oligonucleotide
gggaggacgaugcgguguaggaggaggcgguaccgcagacgacucgcccga

SEQ ID NO: 8518 - RNA, 51 nt, Artificial Sequence
  Description of Artificial Sequence: Synthetic oligonucleotide
gggaggacgaugcggugagucgauguugccguguccagacgacucgcccga

SEQ ID NO: 8519 - RNA, 51 nt, Artificial Sequence
  Description of Artificial Sequence: Synthetic oligonucleotide
gggaggacgaugcgguaaccuaugugugguugcgccagacgacucgcccga

SEQ ID NO: 8520 - RNA, 49 nt, Artificial Sequence
  Description of Artificial Sequence: Synthetic oligonucleotide
gggaggacgaugcgguuugaaggguuggguccgcagacgacucgcccga

SEQ ID NO: 8521 - RNA, 51 nt, Artificial Sequence
  Description of Artificial Sequence: Synthetic oligonucleotide
gggaggacgaugcgguuugaauggagauggguccgcagacgacucgcccga

SEQ ID NO: 8522 - RNA, 52 nt, Artificial Sequence
  Description of Artificial Sequence: Synthetic oligonucleotide
gggaggacgaugcggguccugucgucuguucguccgcagacgacucgcccga

SEQ ID NO: 8523 - RNA, 51 nt, Artificial Sequence
  Description of Artificial Sequence: Synthetic oligonucleotide
gggaggacgaugcggcccuauguucucccgugccccagacgacucgcccga

SEQ ID NO: 8524 - RNA, 51 nt, Artificial Sequence
  Description of Artificial Sequence: Synthetic oligonucleotide
gggaggacgaugcgguuuggaggauggugggaccgcagacgacucgcccga

SEQ ID NO: 8525 - RNA, 51 nt, Artificial Sequence
  Description of Artificial Sequence: Synthetic oligonucleotide
gggaggacgaugcggauuggagaagggugggacugcagacgacucgcccga

SEQ ID NO: 8526 - RNA, 51 nt, Artificial Sequence
  Description of Artificial Sequence: Synthetic oligonucleotide
gggaggacgaugcggauuggugaggggagggacugcagacgacucgcccga

SEQ ID NO: 8527 - RNA, 50 nt, Artificial Sequence
  Description of Artificial Sequence: Synthetic oligonucleotide
gggaggacgaugcgguuggguguagggugguacccagacgacucgcccga

SEQ ID NO: 8528 - RNA, 51 nt, Artificial Sequence
  Description of Artificial Sequence: Synthetic oligonucleotide
gggaggacgaugcgguugggaguggggugggaccgcagacgacucgcccga

SEQ ID NO: 8529 - RNA, 51 nt, Artificial Sequence
  Description of Artificial Sequence: Synthetic oligonucleotide
gggaggacgaugcggauuggagaagggagggaccgcagacgacucgcccga

SEQ ID NO: 8530 - RNA, 51 nt, Artificial Sequence
  Description of Artificial Sequence: Synthetic oligonucleotide
gggaggacgaugcgguguaggaugaggagguaccgcagacgacucgcccga

SEQ ID NO: 8531 - RNA, 51 nt, Artificial Sequence
  Description of Artificial Sequence: Synthetic oligonucleotide
gggaggacgaugcgguuugaaggguggugggcccgcagacgacucgcccga

SEQ ID NO: 8532 - RNA, 50 nt, Artificial Sequence
  Description of Artificial Sequence: Synthetic oligonucleotide
gggaggacgaugcgggucuucuggcuaucguccccagacgacucgcccga

SEQ ID NO: 8533 - RNA, 51 nt, Artificial Sequence
  Description of Artificial Sequence: Synthetic oligonucleotide
gggaggacgaugcgggugauugcugccguccugugcagacgacucgcccga

SEQ ID NO: 8534 - RNA, 51 nt, Artificial Sequence
  Description of Artificial Sequence: Synthetic oligonucleotide
gggaggacgaugcggguugucauauacuccccccccagacgacucgcccga

SEQ ID NO: 8535 - RNA, 51 nt, Artificial Sequence
  Description of Artificial Sequence: Synthetic oligonucleotide
gggaggacgaugcgguugggaguagggugguacugcagacgacucgcccga

SEQ ID NO: 8536 - RNA, 50 nt, Artificial Sequence
  Description of Artificial Sequence: Synthetic oligonucleotide
gggaggacgaugcgggccuuucguucuaccuccccagacgacucgcccga

SEQ ID NO: 8537 - RNA, 49 nt, Artificial Sequence
  Description of Artificial Sequence: Synthetic oligonucleotide
gggaggacgaugcgguccuugucgucuuguccccagacgacucgcccga

SEQ ID NO: 8538 - RNA, 51 nt, Artificial Sequence
  Description of Artificial Sequence: Synthetic oligonucleotide
gggaggacgaugcggcauaguccugucguguugcacagacgacucgcccga

SEQ ID NO: 8539 - RNA, 50 nt, Artificial Sequence
  Description of Artificial Sequence: Synthetic oligonucleotide
gggaggacgaugcgguaucguuacccguuugccccagacgacucgcccga

SEQ ID NO: 8540 - RNA, 51 nt, Artificial Sequence
  Description of Artificial Sequence: Synthetic oligonucleotide
gggaggacgaugcggcgauuugucuuccacgugugcagacgacucgcccga

SEQ ID NO: 8541 - RNA, 51 nt, Artificial Sequence
  Description of Artificial Sequence: Synthetic oligonucleotide
gggaggacgaugcgguuugaaggguggugggucugcagacgacucgcccga

SEQ ID NO: 8542 - RNA, 51 nt, Artificial Sequence
  Description of Artificial Sequence: Synthetic oligonucleotide
gggaggacgaugcgguuugaagggagaugguuccgcagacgacucgcccga

SEQ ID NO: 8543 - RNA, 51 nt, Artificial Sequence
  Description of Artificial Sequence: Synthetic oligonucleotide
gggaggacgaugcgguauuggagguguugggaccgcagacgacucgcccga

SEQ ID NO: 8544 - RNA, 51 nt, Artificial Sequence
  Description of Artificial Sequence: Synthetic oligonucleotide
gggaggacgaugcgguuggguguagggaggcaccgcagacgacucgcccga

SEQ ID NO: 8545 - RNA, 51 nt, Artificial Sequence
  Description of Artificial Sequence: Synthetic oligonucleotide
gggaggacgaugcgguguaggaggaggagguaucgcagacgacucgcccga

SEQ ID NO: 8546 - RNA, 51 nt, Artificial Sequence
  Description of Artificial Sequence: Synthetic oligonucleotide
gggaggacgaugcgguugggaguggggugguaccgcagacgacucgcccga

SEQ ID NO: 8547 - RNA, 49 nt, Artificial Sequence
  Description of Artificial Sequence: Synthetic oligonucleotide
gggaggacgaugcgguauuggagguagggaccgcagacgacucgcccga

SEQ ID NO: 8548 - RNA, 51 nt, Artificial Sequence
  Description of Artificial Sequence: Synthetic oligonucleotide
gggaggacgaugcggcagaagagaagggagguugccagacgacucgcccga

SEQ ID NO: 8549 - RNA, 51 nt, Artificial Sequence
  Description of Artificial Sequence: Synthetic oligonucleotide
gggaggacgaugcgguucucaguauuggucguggccagacgacucgcccga

SEQ ID NO: 8550 - RNA, 51 nt, Artificial Sequence
  Description of Artificial Sequence: Synthetic oligonucleotide
gggaggacgaugcgguggccugucgucuacgugugcagacgacucgcccga

SEQ ID NO: 8551 - RNA, 52 nt, Artificial Sequence
  Description of Artificial Sequence: Synthetic oligonucleotide
gggaggacgaugcggacgugguguagggugguaccgcagacgacucgcccga

SEQ ID NO: 8552 - RNA, 51 nt, Artificial Sequence
  Description of Artificial Sequence: Synthetic oligonucleotide
gggaggacgaugcgggucgauucguuuguccugcccagacgacucgcccga

SEQ ID NO: 8553 - RNA, 51 nt, Artificial Sequence
  Description of Artificial Sequence: Synthetic oligonucleotide
gggaggacgaugcgguccuguguugucuuacacugcagacgacucgcccga

SEQ ID NO: 8554 - RNA, 51 nt, Artificial Sequence
  Description of Artificial Sequence: Synthetic oligonucleotide
gggaggacgaugcgggccuuacguucugaccuccccagacgacucgcccga

SEQ ID NO: 8555 - RNA, 51 nt, Artificial Sequence
  Description of Artificial Sequence: Synthetic oligonucleotide
gggaggacgaugcggugcgaguguuugcugugccccagacgacucgcccga

SEQ ID NO: 8556 - RNA, 51 nt, Artificial Sequence
  Description of Artificial Sequence: Synthetic oligonucleotide
gggaggacgaugcggauccucacccugucgugcugcagacgacucgcccga

SEQ ID NO: 8557 - RNA, 51 nt, Artificial Sequence
  Description of Artificial Sequence: Synthetic oligonucleotide
gggaggacgaugcggaugcgagggaggagggugugcagacgacucgcccga

SEQ ID NO: 8558 - RNA, 50 nt, Artificial Sequence
  Description of Artificial Sequence: Synthetic oligonucleotide
gggaggacgaugcggauuggugaaggggguacugcagacgacucgcccga

SEQ ID NO: 8559 - RNA, 49 nt, Artificial Sequence
  Description of Artificial Sequence: Synthetic oligonucleotide
gggaggacgaugcggucguucccucgucgugugcagacgacucgcccga

SEQ ID NO: 8560 - RNA, 51 nt, Artificial Sequence
  Description of Artificial Sequence: Synthetic oligonucleotide
gggaggacgaugcggcuugucgucuugcucguccccagacgacucgcccga

SEQ ID NO: 8561 - RNA, 51 nt, Artificial Sequence
  Description of Artificial Sequence: Synthetic oligonucleotide
gggaggacgaugcgguccugucgucuguucgucaccagacgacucgcccga

SEQ ID NO: 8562 - RNA, 51 nt, Artificial Sequence
  Description of Artificial Sequence: Synthetic oligonucleotide
gggaggacgaugcggauuccuccgcgugucguuugcagacgacucgcccga

SEQ ID NO: 8563 - RNA, 51 nt, Artificial Sequence
  Description of Artificial Sequence: Synthetic oligonucleotide
gggaggacgaugcggauuggagaagggugguacugcagacgacucgcccga

SEQ ID NO: 8564 - RNA, 51 nt, Artificial Sequence
  Description of Artificial Sequence: Synthetic oligonucleotide
gggaggacgaugcggaauuauagguggacuugcaucagacgacucgcccga

SEQ ID NO: 8565 - RNA, 51 nt, Artificial Sequence
  Description of Artificial Sequence: Synthetic oligonucleotide
gggaggacgaugcggauuggaggagggagggacugcagacgacucgcccga

SEQ ID NO: 8566 - RNA, 49 nt, Artificial Sequence
  Description of Artificial Sequence: Synthetic oligonucleotide
gggaggacgaugcgggcuucguucugcccuccccagacgacucgcccga

SEQ ID NO: 8567 - RNA, 51 nt, Artificial Sequence
  Description of Artificial Sequence: Synthetic oligonucleotide
gggaggacgaugcgguuugggguuuucccguuccccagacgacucgcccga

SEQ ID NO: 8568 - RNA, 51 nt, Artificial Sequence
  Description of Artificial Sequence: Synthetic oligonucleotide
gggaggacgaugcggaucucauggggugauguccccagacgacucgcccga

SEQ ID NO: 8569 - RNA, 50 nt, Artificial Sequence
  Description of Artificial Sequence: Synthetic oligonucleotide
gggaggacgaugcggauuggugaagggagguaugcagacgacucgcccga

SEQ ID NO: 8570 - RNA, 50 nt, Artificial Sequence
  Description of Artificial Sequence: Synthetic oligonucleotide
gggaggacgaugcgguugggugugggugguaccgcagacgacucgcccga

SEQ ID NO: 8571 - RNA, 51 nt, Artificial Sequence
  Description of Artificial Sequence: Synthetic oligonucleotide
gggaggacgaugcgguccugucgucuguuccuccccagacgacucgcccga

SEQ ID NO: 8572 - RNA, 51 nt, Artificial Sequence
  Description of Artificial Sequence: Synthetic oligonucleotide
gggaggacgaugcgguuugaagggggaugggucggcagacgacucgcccga

SEQ ID NO: 8573 - RNA, 51 nt, Artificial Sequence
  Description of Artificial Sequence: Synthetic oligonucleotide
gggaggacgaugcgguuugaagggcuauggguccgcagacgacucgcccga

SEQ ID NO: 8574 - RNA, 51 nt, Artificial Sequence
  Description of Artificial Sequence: Synthetic oligonucleotide
gggaggacgaugcgguuugaagguagauggguccgcagacgacucgcccga

SEQ ID NO: 8575 - RNA, 51 nt, Artificial Sequence
  Description of Artificial Sequence: Synthetic oligonucleotide
gggaggacgaugcgguguagggaggaaguuaucgucagacgacucgcccga

SEQ ID NO: 8576 - RNA, 51 nt, Artificial Sequence
  Description of Artificial Sequence: Synthetic oligonucleotide
gggaggacgaugcgguugggugaagggcgguaccgcagacgacucgcccga

SEQ ID NO: 8577 - RNA, 51 nt, Artificial Sequence
  Description of Artificial Sequence: Synthetic oligonucleotide
gggaggacgaugcgguguagggagguaguuaucggcagacgacucgcccga

SEQ ID NO: 8578 - RNA, 50 nt, Artificial Sequence
  Description of Artificial Sequence: Synthetic oligonucleotide
gggaggacgaugcggcagaggagaagggagguugcagacgacucgcccga

SEQ ID NO: 8579 - RNA, 51 nt, Artificial Sequence
  Description of Artificial Sequence: Synthetic oligonucleotide
gggaggacgaugcggguuugcgucugaccuguccccagacgacucgcccga

SEQ ID NO: 8580 - RNA, 51 nt, Artificial Sequence
  Description of Artificial Sequence: Synthetic oligonucleotide
gggaggacgaugcggcuugucgucuuguuucuccccagacgacucgcccga

SEQ ID NO: 8581 - RNA, 51 nt, Artificial Sequence
  Description of Artificial Sequence: Synthetic oligonucleotide
gggaggacgaugcgguagcgucgucuggccaugugcagacgacucgcccga

SEQ ID NO: 8582 - RNA, 51 nt, Artificial Sequence
  Description of Artificial Sequence: Synthetic oligonucleotide
gggaggacgaugcggucauguccugccacguugcccagacgacucgcccga

SEQ ID NO: 8583 - RNA, 51 nt, Artificial Sequence
  Description of Artificial Sequence: Synthetic oligonucleotide
gggaggacgaugcggucccaaaugccucccgugugcagacgacucgcccga

SEQ ID NO: 8584 - RNA, 51 nt, Artificial Sequence
  Description of Artificial Sequence: Synthetic oligonucleotide
gggaggacgaugcggucguuuggucucuggugccccagacgacucgcccga

SEQ ID NO: 8585 - RNA, 51 nt, Artificial Sequence
  Description of Artificial Sequence: Synthetic oligonucleotide
gggaggacgaugcgguguaggaguaggagguaccgcagacgacucgcccga

SEQ ID NO: 8586 - RNA, 51 nt, Artificial Sequence
  Description of Artificial Sequence: Synthetic oligonucleotide
gggaggacgaugcggacugauauccucccguuggccagacgacucgcccga

SEQ ID NO: 8587 - RNA, 51 nt, Artificial Sequence
  Description of Artificial Sequence: Synthetic oligonucleotide
gggaggacgaugcggagugggcugugguguacgugcagacgacucgcccga

SEQ ID NO: 8588 - RNA, 51 nt, Artificial Sequence
  Description of Artificial Sequence: Synthetic oligonucleotide
gggaggacgaugcgguuugaagggcgaugggucagcagacgacucgcccga

SEQ ID NO: 8589 - RNA, 51 nt, Artificial Sequence
  Description of Artificial Sequence: Synthetic oligonucleotide
gggaggacgaugcgguguaagaggaggagguaccgcagacgacucgcccga

SEQ ID NO: 8590 - RNA, 52 nt, Artificial Sequence
  Description of Artificial Sequence: Synthetic oligonucleotide
gggaggacgaugcggguccuguugucuguucguccccagacgacucgcccga

SEQ ID NO: 8591 - RNA, 51 nt, Artificial Sequence
  Description of Artificial Sequence: Synthetic oligonucleotide
gggaggacgaugcggaauucgugcuucgcggucgccagacgacucgcccga

SEQ ID NO: 8592 - RNA, 50 nt, Artificial Sequence
  Description of Artificial Sequence: Synthetic oligonucleotide
gggaggacgaugcgguuggguguagggugguacgcagacgacucgcccga

SEQ ID NO: 8593 - RNA, 51 nt, Artificial Sequence
  Description of Artificial Sequence: Synthetic oligonucleotide
gggaggacgaugcgguugggaguaggaugguaccgcagacgacucgcccga

SEQ ID NO: 8594 - RNA, 51 nt, Artificial Sequence
  Description of Artificial Sequence: Synthetic oligonucleotide
gggaggacgaugcgguuugaaggguggugguuccgcagacgacucgcccga

SEQ ID NO: 8595 - RNA, 52 nt, Artificial Sequence
  Description of Artificial Sequence: Synthetic oligonucleotide
gggaggacgaugcgggcgggguguagggugguaccgcagacgacucgcccga

SEQ ID NO: 8596 - RNA, 51 nt, Artificial Sequence
  Description of Artificial Sequence: Synthetic oligonucleotide
gggaggacgaugcgguauuggaggugcagggaccgcagacgacucgcccga

SEQ ID NO: 8597 - RNA, 51 nt, Artificial Sequence
  Description of Artificial Sequence: Synthetic oligonucleotide
gggaggacgaugcgguucgaagggggauggguccgcagacgacucgcccga

SEQ ID NO: 8598 - RNA, 51 nt, Artificial Sequence
  Description of Artificial Sequence: Synthetic oligonucleotide
gggaggacgaugcgguguagggagggaguuaucgucagacgacucgcccga

SEQ ID NO: 8599 - RNA, 51 nt, Artificial Sequence
  Description of Artificial Sequence: Synthetic oligonucleotide
gggaggacgaugcggccgcuucgucacgugcugugcagacgacucgcccga

SEQ ID NO: 8600 - RNA, 51 nt, Artificial Sequence
  Description of Artificial Sequence: Synthetic oligonucleotide
gggaggacgaugcggcgacuccucugguucguccccagacgacucgcccga

SEQ ID NO: 8601 - RNA, 51 nt, Artificial Sequence
  Description of Artificial Sequence: Synthetic oligonucleotide
gggaggacgaugcggauccucgaacguugugucgccagacgacucgcccga

SEQ ID NO: 8602 - RNA, 51 nt, Artificial Sequence
  Description of Artificial Sequence: Synthetic oligonucleotide
gggaggacgaugcgguuagccucccgacugcucgccagacgacucgcccga

SEQ ID NO: 8603 - RNA, 51 nt, Artificial Sequence
  Description of Artificial Sequence: Synthetic oligonucleotide
gggaggacgaugcggaaucccgucgucuugcgcgccagacgacucgcccga

SEQ ID NO: 8604 - RNA, 51 nt, Artificial Sequence
  Description of Artificial Sequence: Synthetic oligonucleotide
gggaggacgaugcggccgcugucuuccguagucugcagacgacucgcccga

SEQ ID NO: 8605 - RNA, 51 nt, Artificial Sequence
  Description of Artificial Sequence: Synthetic oligonucleotide
gggaggacgaugcgguguaggaggaggauguaccgcagacgacucgcccga

SEQ ID NO: 8606 - RNA, 51 nt, Artificial Sequence
  Description of Artificial Sequence: Synthetic oligonucleotide
gggaggacgaugcggccauauugucccgucugcugcagacgacucgcccga

SEQ ID NO: 8607 - RNA, 51 nt, Artificial Sequence
  Description of Artificial Sequence: Synthetic oligonucleotide
gggaggacgaugcgguuagccguucugguguuggccagacgacucgcccga

SEQ ID NO: 8608 - RNA, 50 nt, Artificial Sequence
  Description of Artificial Sequence: Synthetic oligonucleotide
gggaggacgaugcgguccugucguccuucguccccagacgacucgcccga

SEQ ID NO: 8609 - RNA, 49 nt, Artificial Sequence
  Description of Artificial Sequence: Synthetic oligonucleotide
gggaggacgaugcgguccuggucuguucguccccagacgacucgcccga

SEQ ID NO: 8610 - RNA, 51 nt, Artificial Sequence
  Description of Artificial Sequence: Synthetic oligonucleotide
gggaggacgaugcggucgacauacgucugugcccccagacgacucgcccga

SEQ ID NO: 8611 - RNA, 51 nt, Artificial Sequence
  Description of Artificial Sequence: Synthetic oligonucleotide
gggaggacgaugcggucagagagccuccugcuccccagacgacucgcccga

SEQ ID NO: 8612 - RNA, 51 nt, Artificial Sequence
  Description of Artificial Sequence: Synthetic oligonucleotide
gggaggacgaugcggauaguuggacuggugcugugcagacgacucgcccga

SEQ ID NO: 8613 - RNA, 51 nt, Artificial Sequence
  Description of Artificial Sequence: Synthetic oligonucleotide
gggaggacgaugcggcauuuuugguuggacagcugcagacgacucgcccga

SEQ ID NO: 8614 - RNA, 51 nt, Artificial Sequence
  Description of Artificial Sequence: Synthetic oligonucleotide
gggaggacgaugcggauccuccuggucgugguguccagacgacucgcccga

SEQ ID NO: 8615 - RNA, 51 nt, Artificial Sequence
  Description of Artificial Sequence: Synthetic oligonucleotide
gggaggacgaugcggugugucguccacaaugugugcagacgacucgcccga

SEQ ID NO: 8616 - RNA, 51 nt, Artificial Sequence
  Description of Artificial Sequence: Synthetic oligonucleotide
gggaggacgaugcggagcguaguugcaugcugccccagacgacucgcccga

SEQ ID NO: 8617 - RNA, 50 nt, Artificial Sequence
  Description of Artificial Sequence: Synthetic oligonucleotide
gggaggacgaugcggccuguugucugaugcgcgccagacgacucgcccga

SEQ ID NO: 8618 - RNA, 50 nt, Artificial Sequence
  Description of Artificial Sequence: Synthetic oligonucleotide
gggaggacgaugcgggccuuucguucugucuccccagacgacucgcccga

SEQ ID NO: 8619 - RNA, 51 nt, Artificial Sequence
  Description of Artificial Sequence: Synthetic oligonucleotide
gggaggacgaugcgguccugucgucuguucgaccccagacgacucgcccga

SEQ ID NO: 8620 - RNA, 51 nt, Artificial Sequence
  Description of Artificial Sequence: Synthetic oligonucleotide
gggaggacgaugcggugccgcgauaccaugcucgccagacgacucgcccga

SEQ ID NO: 8621 - RNA, 51 nt, Artificial Sequence
  Description of Artificial Sequence: Synthetic oligonucleotide
gggaggacgaugcggugacucgucuguuucguccgcagacgacucgcccga

SEQ ID NO: 8622 - RNA, 51 nt, Artificial Sequence
  Description of Artificial Sequence: Synthetic oligonucleotide
gggaggacgaugcgguccugucgucuguuaguccccagacgacucgcccga

SEQ ID NO: 8623 - RNA, 51 nt, Artificial Sequence
  Description of Artificial Sequence: Synthetic oligonucleotide
gggaggacgaugcgguccuuucgucuguucguccccagacgacucgcccga

SEQ ID NO: 8624 - RNA, 51 nt, Artificial Sequence
  Description of Artificial Sequence: Synthetic oligonucleotide
gggaggacgaugcgguuugaagagagauggguccgcagacgacucgcccga

SEQ ID NO: 8625 - RNA, 52 nt, Artificial Sequence
  Description of Artificial Sequence: Synthetic oligonucleotide
gggaggacgaugcgguuugaagggugaugggucccgcagacgacucgcccga

SEQ ID NO: 8626 - RNA, 51 nt, Artificial Sequence
  Description of Artificial Sequence: Synthetic oligonucleotide
gggaggacgaugcggauuguugaagggagguaccgcagacgacucgcccga

SEQ ID NO: 8627 - RNA, 50 nt, Artificial Sequence
  Description of Artificial Sequence: Synthetic oligonucleotide
gggaggacgaugcggcuugucgucuguucguccccagacgacucgcccga

SEQ ID NO: 8628 - RNA, 51 nt, Artificial Sequence
  Description of Artificial Sequence: Synthetic oligonucleotide
gggaggacgaugcgguguaggaggaggagguacagcagacgacucgcccga

SEQ ID NO: 8629 - RNA, 51 nt, Artificial Sequence
  Description of Artificial Sequence: Synthetic oligonucleotide
gggaggacgaugcgguacuggagguguagggaccgcagacgacucgcccga

SEQ ID NO: 8630 - RNA, 51 nt, Artificial Sequence
  Description of Artificial Sequence: Synthetic oligonucleotide
gggaggacgaugcgguuugguguagggagguaccgcagacgacucgcccga

SEQ ID NO: 8631 - RNA, 51 nt, Artificial Sequence
  Description of Artificial Sequence: Synthetic oligonucleotide
gggaggacgaugcgguuugaagggugauggugccgcagacgacucgcccga

SEQ ID NO: 8632 - RNA, 51 nt, Artificial Sequence
  Description of Artificial Sequence: Synthetic oligonucleotide
gggaggacgaugcgguuggggggagggugguaccgcagacgacucgcccga

SEQ ID NO: 8633 - RNA, 51 nt, Artificial Sequence
  Description of Artificial Sequence: Synthetic oligonucleotide
gggaggacgaugcgguauuggagguguagggacggcagacgacucgcccga

SEQ ID NO: 8634 - RNA, 51 nt, Artificial Sequence
  Description of Artificial Sequence: Synthetic oligonucleotide
gggaggacgaugcggaguaggaggaggagguaccgcagacgacucgcccga

SEQ ID NO: 8635 - RNA, 52 nt, Artificial Sequence
  Description of Artificial Sequence: Synthetic oligonucleotide
gggaggacgaugcgguuggguguagggggguuaccgcagacgacucgcccga

SEQ ID NO: 8636 - RNA, 51 nt, Artificial Sequence
  Description of Artificial Sequence: Synthetic oligonucleotide
gggaggacgaugcggauagggagaagggugaacugcagacgacucgcccga

SEQ ID NO: 8637 - RNA, 51 nt, Artificial Sequence
  Description of Artificial Sequence: Synthetic oligonucleotide
gggaggacgaugcgguuggguguaggggggaaccgcagacgacucgcccga

SEQ ID NO: 8638 - RNA, 51 nt, Artificial Sequence
  Description of Artificial Sequence: Synthetic oligonucleotide
gggaggacgaugcgguaagauggugagcacguguccagacgacucgcccga

SEQ ID NO: 8639 - RNA, 51 nt, Artificial Sequence
  Description of Artificial Sequence: Synthetic oligonucleotide
gggaggacgaugcgguucguuuugcuccccgugugcagacgacucgcccga

SEQ ID NO: 8640 - RNA, 51 nt, Artificial Sequence
  Description of Artificial Sequence: Synthetic oligonucleotide
gggaggacgaugcgggaggugucuggaugucugugcagacgacucgcccga

SEQ ID NO: 8641 - RNA, 51 nt, Artificial Sequence
  Description of Artificial Sequence: Synthetic oligonucleotide
gggaggacgaugcggcauugucccggucgguacugcagacgacucgcccga

SEQ ID NO: 8642 - RNA, 51 nt, Artificial Sequence
  Description of Artificial Sequence: Synthetic oligonucleotide
gggaggacgaugcgguaccgcucacuugucgugugcagacgacucgcccga

SEQ ID NO: 8643 - RNA, 51 nt, Artificial Sequence
  Description of Artificial Sequence: Synthetic oligonucleotide
gggaggacgaugcggaugggucgucuuuaccuccccagacgacucgcccga

SEQ ID NO: 8644 - RNA, 51 nt, Artificial Sequence
  Description of Artificial Sequence: Synthetic oligonucleotide
gggaggacgaugcgguggucucugguucugugggccagacgacucgcccga

SEQ ID NO: 8645 - RNA, 51 nt, Artificial Sequence
  Description of Artificial Sequence: Synthetic oligonucleotide
gggaggacgaugcggaugauguugucccaugugugcagacgacucgcccga

SEQ ID NO: 8646 - RNA, 51 nt, Artificial Sequence
  Description of Artificial Sequence: Synthetic oligonucleotide
gggaggacgaugcggugucgaguuuuuuggugccccagacgacucgcccga

SEQ ID NO: 8647 - RNA, 51 nt, Artificial Sequence
  Description of Artificial Sequence: Synthetic oligonucleotide
gggaggacgaugcgguccuguagucuguucguccccagacgacucgcccga

SEQ ID NO: 8648 - RNA, 51 nt, Artificial Sequence
  Description of Artificial Sequence: Synthetic oligonucleotide
gggaggacgaugcggaugugugagaugcccugcgccagacgacucgcccga

SEQ ID NO: 8649 - RNA, 51 nt, Artificial Sequence
  Description of Artificial Sequence: Synthetic oligonucleotide
gggaggacgaugcgguccugucuugucguuguccccagacgacucgcccga

SEQ ID NO: 8650 - RNA, 51 nt, Artificial Sequence
  Description of Artificial Sequence: Synthetic oligonucleotide
gggaggacgaugcggacguugucccacugugucgccagacgacucgcccga

SEQ ID NO: 8651 - RNA, 51 nt, Artificial Sequence
  Description of Artificial Sequence: Synthetic oligonucleotide
gggaggacgaugcgggccuuugguucugaccuccccagacgacucgcccga

SEQ ID NO: 8652 - RNA, 50 nt, Artificial Sequence
  Description of Artificial Sequence: Synthetic oligonucleotide
gggaggacgaugcgguuugauggugauggguccgcagacgacucgcccga

SEQ ID NO: 8653 - RNA, 50 nt, Artificial Sequence
  Description of Artificial Sequence: Synthetic oligonucleotide
gggaggacgaugcgguuugggguuuuccgugccccagacgacucgcccga

SEQ ID NO: 8654 - RNA, 52 nt, Artificial Sequence
  Description of Artificial Sequence: Synthetic oligonucleotide
gggaggacgaugcggauuggugaaggggagguacugcagacgacucgcccga

SEQ ID NO: 8655 - RNA, 51 nt, Artificial Sequence
  Description of Artificial Sequence: Synthetic oligonucleotide
gggaggacgaugcggugagugguuauggaccggugcagacgacucgcccga

SEQ ID NO: 8656 - RNA, 51 nt, Artificial Sequence
  Description of Artificial Sequence: Synthetic oligonucleotide
gggaggacgaugcggucaugucgucuguucguccccagacgacucgcccga

SEQ ID NO: 8657 - RNA, 51 nt, Artificial Sequence
  Description of Artificial Sequence: Synthetic oligonucleotide
gggaggacgaugcgguuugaagagugguggguccgcagacgacucgcccga

SEQ ID NO: 8658 - RNA, 51 nt, Artificial Sequence
  Description of Artificial Sequence: Synthetic oligonucleotide
gggaggacgaugcgguuuggagggggaugggacugcagacgacucgcccga

SEQ ID NO: 8659 - RNA, 52 nt, Artificial Sequence
  Description of Artificial Sequence: Synthetic oligonucleotide
gggaggacgaugcgguuugaagggugaugggugccgcagacgacucgcccga

SEQ ID NO: 8660 - RNA, 51 nt, Artificial Sequence
  Description of Artificial Sequence: Synthetic oligonucleotide
gggaggacgaugcggauagggagaagggagaaccgcagacgacucgcccga

SEQ ID NO: 8661 - RNA, 51 nt, Artificial Sequence
  Description of Artificial Sequence: Synthetic oligonucleotide
gggaggacgaugcgguuuggaggggggugggacugcagacgacucgcccga

SEQ ID NO: 8662 - RNA, 51 nt, Artificial Sequence
  Description of Artificial Sequence: Synthetic oligonucleotide
gggaggacgaugcgguuugaagggggauguguccgcagacgacucgcccga

SEQ ID NO: 8663 - RNA, 51 nt, Artificial Sequence
  Description of Artificial Sequence: Synthetic oligonucleotide
gggaggacgaugcgguuugaagggggagggguccgcagacgacucgcccga

SEQ ID NO: 8664 - RNA, 51 nt, Artificial Sequence
  Description of Artificial Sequence: Synthetic oligonucleotide
gggaggacgaugcgguuggguguagggggggaccgcagacgacucgcccga

SEQ ID NO: 8665 - RNA, 51 nt, Artificial Sequence
  Description of Artificial Sequence: Synthetic oligonucleotide
gggaggacgaugcgguauuggugguguagggaccgcagacgacucgcccga

SEQ ID NO: 8666 - RNA, 53 nt, Artificial Sequence
  Description of Artificial Sequence: Synthetic oligonucleotide
gggaggacgaugcgguauuugaagggugauggguccgcagacgacucgcccga

SEQ ID NO: 8667 - RNA, 51 nt, Artificial Sequence
  Description of Artificial Sequence: Synthetic oligonucleotide
gggaggacgaugcggauugaagggcgauggguccgcagacgacucgcccga

SEQ ID NO: 8668 - RNA, 51 nt, Artificial Sequence
  Description of Artificial Sequence: Synthetic oligonucleotide
gggaggacgaugcgguuugaagggcgauguguccgcagacgacucgcccga

SEQ ID NO: 8669 - RNA, 51 nt, Artificial Sequence
  Description of Artificial Sequence: Synthetic oligonucleotide
gggaggacgaugcgguauuggagguguagggaccacagacgacucgcccga

SEQ ID NO: 8670 - RNA, 51 nt, Artificial Sequence
  Description of Artificial Sequence: Synthetic oligonucleotide
gggaggacgaugcgguccugucgucuguucgugcccagacgacucgcccga

SEQ ID NO: 8671 - RNA, 51 nt, Artificial Sequence
  Description of Artificial Sequence: Synthetic oligonucleotide
gggaggacgaugcgguucgaagggcgauggguccgcagacgacucgcccga

SEQ ID NO: 8672 - RNA, 51 nt, Artificial Sequence
  Description of Artificial Sequence: Synthetic oligonucleotide
gggaggacgaugcggugauuuccucguugucugugcagacgacucgcccga

SEQ ID NO: 8673 - RNA, 51 nt, Artificial Sequence
  Description of Artificial Sequence: Synthetic oligonucleotide
gggaggacgaugcggugagugccugcgaccguguccagacgacucgcccga

SEQ ID NO: 8674 - RNA, 51 nt, Artificial Sequence
  Description of Artificial Sequence: Synthetic oligonucleotide
gggaggacgaugcggccauuaggaguagggagguacagacgacucgcccga

SEQ ID NO: 8675 - RNA, 50 nt, Artificial Sequence
  Description of Artificial Sequence: Synthetic oligonucleotide
gggaggacgaugcggguugcagucuguccgugugcagacgacucgcccga

SEQ ID NO: 8676 - RNA, 51 nt, Artificial Sequence
  Description of Artificial Sequence: Synthetic oligonucleotide
gggaggacgaugcgguccugucgucuguucgucgccagacgacucgcccga

SEQ ID NO: 8677 - RNA, 51 nt, Artificial Sequence
  Description of Artificial Sequence: Synthetic oligonucleotide
gggaggacgaugcggcgucguaaugguuugugguccagacgacucgcccga

SEQ ID NO: 8678 - RNA, 51 nt, Artificial Sequence
  Description of Artificial Sequence: Synthetic oligonucleotide
gggaggacgaugcggaaugucgaaccacugcuccccagacgacucgcccga

SEQ ID NO: 8679 - RNA, 51 nt, Artificial Sequence
  Description of Artificial Sequence: Synthetic oligonucleotide
gggaggacgaugcggacagucgugucugguuuguacagacgacucgcccga

SEQ ID NO: 8680 - RNA, 51 nt, Artificial Sequence
  Description of Artificial Sequence: Synthetic oligonucleotide
gggaggacgaugcggcguuuccucugguucguucccagacgacucgcccga

SEQ ID NO: 8681 - RNA, 51 nt, Artificial Sequence
  Description of Artificial Sequence: Synthetic oligonucleotide
gggaggacgaugcggagagucgccguguuccugugcagacgacucgcccga

SEQ ID NO: 8682 - RNA, 51 nt, Artificial Sequence
  Description of Artificial Sequence: Synthetic oligonucleotide
gggaggacgaugcggaaccgugcggaucuccugugcagacgacucgcccga

SEQ ID NO: 8683 - RNA, 51 nt, Artificial Sequence
  Description of Artificial Sequence: Synthetic oligonucleotide
gggaggacgaugcggacaugauuaacuacugugcccagacgacucgcccga

SEQ ID NO: 8684 - RNA, 51 nt, Artificial Sequence
  Description of Artificial Sequence: Synthetic oligonucleotide
gggaggacgaugcggcagaggagaagggaaguugccagacgacucgcccga

SEQ ID NO: 8685 - RNA, 51 nt, Artificial Sequence
  Description of Artificial Sequence: Synthetic oligonucleotide
gggaggacgaugcgguggaucgcuggcuuaugcgccagacgacucgcccga

SEQ ID NO: 8686 - RNA, 51 nt, Artificial Sequence
  Description of Artificial Sequence: Synthetic oligonucleotide
gggaggacgaugcgggccuuuccuucugaccuccccagacgacucgcccga

SEQ ID NO: 8687 - RNA, 51 nt, Artificial Sequence
  Description of Artificial Sequence: Synthetic oligonucleotide
gggaggacgaugcggaucguuaccuucugccuccccagacgacucgcccga

SEQ ID NO: 8688 - RNA, 51 nt, Artificial Sequence
  Description of Artificial Sequence: Synthetic oligonucleotide
gggaggacgaugcggcaagucguucguaaccugugcagacgacucgcccga

SEQ ID NO: 8689 - RNA, 51 nt, Artificial Sequence
  Description of Artificial Sequence: Synthetic oligonucleotide
gggaggacgaugcggcagguugugugagugugccccagacgacucgcccga

SEQ ID NO: 8690 - RNA, 51 nt, Artificial Sequence
  Description of Artificial Sequence: Synthetic oligonucleotide
gggaggacgaugcggacagcacuucacgcuguugccagacgacucgcccga

SEQ ID NO: 8691 - RNA, 51 nt, Artificial Sequence
  Description of Artificial Sequence: Synthetic oligonucleotide
gggaggacgaugcggaacccauuguccucgcugcccagacgacucgcccga

SEQ ID NO: 8692 - RNA, 51 nt, Artificial Sequence
  Description of Artificial Sequence: Synthetic oligonucleotide
gggaggacgaugcggaggagagggguucgucuucccagacgacucgcccga

SEQ ID NO: 8693 - RNA, 51 nt, Artificial Sequence
  Description of Artificial Sequence: Synthetic oligonucleotide
gggaggacgaugcgguuugggguuuucccgugcuccagacgacucgcccga

SEQ ID NO: 8694 - RNA, 51 nt, Artificial Sequence
  Description of Artificial Sequence: Synthetic oligonucleotide
gggaggacgaugcgguuugggguuuucccgugccucagacgacucgcccga

SEQ ID NO: 8695 - RNA, 51 nt, Artificial Sequence
  Description of Artificial Sequence: Synthetic oligonucleotide
gggaggacgaugcggcgucuccucugguucguccccagacgacucgcccga

SEQ ID NO: 8696 - RNA, 51 nt, Artificial Sequence
  Description of Artificial Sequence: Synthetic oligonucleotide
gggaggacgaugcggccaaucgucuccguguugugcagacgacucgcccga

SEQ ID NO: 8697 - RNA, 51 nt, Artificial Sequence
  Description of Artificial Sequence: Synthetic oligonucleotide
gggaggacgaugcgguuuggagaagggagggacugcagacgacucgcccga

SEQ ID NO: 8698 - RNA, 51 nt, Artificial Sequence
  Description of Artificial Sequence: Synthetic oligonucleotide
gggaggacgaugcgguuugauucgucuccugugcccagacgacucgcccga

SEQ ID NO: 8699 - RNA, 51 nt, Artificial Sequence
  Description of Artificial Sequence: Synthetic oligonucleotide
gggaggacgaugcggugcgcuccucuaguugucugcagacgacucgcccga

SEQ ID NO: 8700 - RNA, 51 nt, Artificial Sequence
  Description of Artificial Sequence: Synthetic oligonucleotide
gggaggacgaugcgguaaccauaaaugaugcgcugcagacgacucgcccga

SEQ ID NO: 8701 - RNA, 51 nt, Artificial Sequence
  Description of Artificial Sequence: Synthetic oligonucleotide
gggaggacgaugcggcuugaagggugauggguccccagacgacucgcccga

SEQ ID NO: 8702 - RNA, 51 nt, Artificial Sequence
  Description of Artificial Sequence: Synthetic oligonucleotide
gggaggacgaugcggguuggugaagggaggugcugcagacgacucgcccga

SEQ ID NO: 8703 - RNA, 51 nt, Artificial Sequence
  Description of Artificial Sequence: Synthetic oligonucleotide
gggaggacgaugcgguuugaagggugguggauccgcagacgacucgcccga

SEQ ID NO: 8704 - RNA, 50 nt, Artificial Sequence
  Description of Artificial Sequence: Synthetic oligonucleotide
gggaggacgaugcggauugugaagggagguaccgcagacgacucgcccga

SEQ ID NO: 8705 - RNA, 51 nt, Artificial Sequence
  Description of Artificial Sequence: Synthetic oligonucleotide
gggaggacgaugcggauuggugcagggagguaccgcagacgacucgcccga

SEQ ID NO: 8706 - RNA, 51 nt, Artificial Sequence
  Description of Artificial Sequence: Synthetic oligonucleotide
gggaggacgaugcggauuggagaagggaggcacugcagacgacucgcccga

SEQ ID NO: 8707 - RNA, 51 nt, Artificial Sequence
  Description of Artificial Sequence: Synthetic oligonucleotide
gggaggacgaugcgguuugaaggaugaugggaccgcagacgacucgcccga

SEQ ID NO: 8708 - RNA, 51 nt, Artificial Sequence
  Description of Artificial Sequence: Synthetic oligonucleotide
gggaggacgaugcgggccuugcguucugcccuccccagacgacucgcccga

SEQ ID NO: 8709 - RNA, 51 nt, Artificial Sequence
  Description of Artificial Sequence: Synthetic oligonucleotide
gggaggacgaugcggguugaagggagauggguccgcagacgacucgcccga

SEQ ID NO: 8710 - RNA, 51 nt, Artificial Sequence
  Description of Artificial Sequence: Synthetic oligonucleotide
gggaggacgaugcgguuugaggggagauggguccgcagacgacucgcccga

SEQ ID NO: 8711 - RNA, 51 nt, Artificial Sequence
  Description of Artificial Sequence: Synthetic oligonucleotide
gggaggacgaugcgguuugaagggcgaugguuccgcagacgacucgcccga

SEQ ID NO: 8712 - RNA, 52 nt, Artificial Sequence
  Description of Artificial Sequence: Synthetic oligonucleotide
gggaggacgaugcgguuuugaagggggauggguccgcagacgacucgcccga

SEQ ID NO: 8713 - RNA, 51 nt, Artificial Sequence
  Description of Artificial Sequence: Synthetic oligonucleotide
gggaggacgaugcggagaguugucuaugcugcccccagacgacucgcccga

SEQ ID NO: 8714 - RNA, 51 nt, Artificial Sequence
  Description of Artificial Sequence: Synthetic oligonucleotide
gggaggacgaugcggcagaggauaagggagguugccagacgacucgcccga

SEQ ID NO: 8715 - RNA, 51 nt, Artificial Sequence
  Description of Artificial Sequence: Synthetic oligonucleotide
gggaggacgaugcggaugucaugugaaugccgugccagacgacucgcccga

SEQ ID NO: 8716 - RNA, 51 nt, Artificial Sequence
  Description of Artificial Sequence: Synthetic oligonucleotide
gggaggacgaugcggucuugucgucugcucguccccagacgacucgcccga

SEQ ID NO: 8717 - RNA, 51 nt, Artificial Sequence
  Description of Artificial Sequence: Synthetic oligonucleotide
gggaggacgaugcggagaguccuacgccuguugugcagacgacucgcccga

SEQ ID NO: 8718 - RNA, 51 nt, Artificial Sequence
  Description of Artificial Sequence: Synthetic oligonucleotide
gggaggacgaugcggugugcguucuccguguugugcagacgacucgcccga

SEQ ID NO: 8719 - RNA, 51 nt, Artificial Sequence
  Description of Artificial Sequence: Synthetic oligonucleotide
gggaggacgaugcggguugaagggugauggguccccagacgacucgcccga

SEQ ID NO: 8720 - RNA, 51 nt, Artificial Sequence
  Description of Artificial Sequence: Synthetic oligonucleotide
gggaggacgaugcgguacacccuggcucucgucugcagacgacucgcccga

SEQ ID NO: 8721 - RNA, 51 nt, Artificial Sequence
  Description of Artificial Sequence: Synthetic oligonucleotide
gggaggacgaugcggcuacgucagucugcuggugccagacgacucgcccga

SEQ ID NO: 8722 - RNA, 50 nt, Artificial Sequence
  Description of Artificial Sequence: Synthetic oligonucleotide
gggaggacgaugcgggccuuucgugugcccuccccagacgacucgcccga

SEQ ID NO: 8723 - RNA, 51 nt, Artificial Sequence
  Description of Artificial Sequence: Synthetic oligonucleotide
gggaggacgaugcggcagaguagaagggagguugccagacgacucgcccga

SEQ ID NO: 8724 - RNA, 51 nt, Artificial Sequence
  Description of Artificial Sequence: Synthetic oligonucleotide
gggaggacgaugcgguaaguccgcaguguuggccgcagacgacucgcccga

SEQ ID NO: 8725 - RNA, 49 nt, Artificial Sequence
  Description of Artificial Sequence: Synthetic oligonucleotide
gggaggacgaugcgggccucguucugcccuccccagacgacucgcccga

SEQ ID NO: 8726 - RNA, 51 nt, Artificial Sequence
  Description of Artificial Sequence: Synthetic oligonucleotide
gggaggacgaugcggguggccgucuucguguugugcagacgacucgcccga

SEQ ID NO: 8727 - RNA, 51 nt, Artificial Sequence
  Description of Artificial Sequence: Synthetic oligonucleotide
gggaggacgaugcgguuggggguagggugguacugcagacgacucgcccga

SEQ ID NO: 8728 - RNA, 51 nt, Artificial Sequence
  Description of Artificial Sequence: Synthetic oligonucleotide
gggaggacgaugcgguacgucuuccugugccuccccagacgacucgcccga

SEQ ID NO: 8729 - RNA, 50 nt, Artificial Sequence
  Description of Artificial Sequence: Synthetic oligonucleotide
gggaggacgaugcggauuuuggagaagggaggugcagacgacucgcccga

SEQ ID NO: 8730 - RNA, 51 nt, Artificial Sequence
  Description of Artificial Sequence: Synthetic oligonucleotide
gggaggacgaugcggcuaguugcaugccaccugugcagacgacucgcccga

SEQ ID NO: 8731 - RNA, 51 nt, Artificial Sequence
  Description of Artificial Sequence: Synthetic oligonucleotide
gggaggacgaugcggauuggugaagggagguaucgcagacgacucgcccga

SEQ ID NO: 8732 - RNA, 51 nt, Artificial Sequence
  Description of Artificial Sequence: Synthetic oligonucleotide
gggaggacgaugcggauggguguagggagguaccgcagacgacucgcccga

SEQ ID NO: 8733 - RNA, 51 nt, Artificial Sequence
  Description of Artificial Sequence: Synthetic oligonucleotide
gggaggacgaugcgguuugaagggggaaggguccgcagacgacucgcccga

SEQ ID NO: 8734 - RNA, 51 nt, Artificial Sequence
  Description of Artificial Sequence: Synthetic oligonucleotide
gggaggacgaugcggauuggugaagggaggucccgcagacgacucgcccga

SEQ ID NO: 8735 - RNA, 51 nt, Artificial Sequence
  Description of Artificial Sequence: Synthetic oligonucleotide
gggaggacgaugcgguuugaaggucgauggguccgcagacgacucgcccga

SEQ ID NO: 8736 - RNA, 51 nt, Artificial Sequence
  Description of Artificial Sequence: Synthetic oligonucleotide
gggaggacgaugcgguccaccucguauucgugccccagacgacucgcccga

SEQ ID NO: 8737 - RNA, 51 nt, Artificial Sequence
  Description of Artificial Sequence: Synthetic oligonucleotide
gggaggacgaugcgggccuuucguacugaccuccccagacgacucgcccga

SEQ ID NO: 8738 - RNA, 51 nt, Artificial Sequence
  Description of Artificial Sequence: Synthetic oligonucleotide
gggaggacgaugcgguccuggcgucuguucguccccagacgacucgcccga

SEQ ID NO: 8739 - RNA, 51 nt, Artificial Sequence
  Description of Artificial Sequence: Synthetic oligonucleotide
gggaggacgaugcgguccgcacaacguuccugccccagacgacucgcccga

SEQ ID NO: 8740 - RNA, 51 nt, Artificial Sequence
  Description of Artificial Sequence: Synthetic oligonucleotide
gggaggacgaugcgguuugaagggggcuggguccgcagacgacucgcccga

SEQ ID NO: 8741 - RNA, 51 nt, Artificial Sequence
  Description of Artificial Sequence: Synthetic oligonucleotide
gggaggacgaugcgguuugaagggauauggguccgcagacgacucgcccga

SEQ ID NO: 8742 - RNA, 51 nt, Artificial Sequence
  Description of Artificial Sequence: Synthetic oligonucleotide
gggaggacgaugcgguuugagaggugauggguccgcagacgacucgcccga

SEQ ID NO: 8743 - RNA, 51 nt, Artificial Sequence
  Description of Artificial Sequence: Synthetic oligonucleotide
gggaggacgaugcgguuggaaggggggugggaccgcagacgacucgcccga

SEQ ID NO: 8744 - RNA, 50 nt, Artificial Sequence
  Description of Artificial Sequence: Synthetic oligonucleotide
gggaggacgaugcgguugaagggagauggguccgcagacgacucgcccga

SEQ ID NO: 8745 - RNA, 51 nt, Artificial Sequence
  Description of Artificial Sequence: Synthetic oligonucleotide
gggaggacgaugcgguuggaaggagggugggaccgcagacgacucgcccga

SEQ ID NO: 8746 - RNA, 51 nt, Artificial Sequence
  Description of Artificial Sequence: Synthetic oligonucleotide
gggaggacgaugcgguauuggagguguaaggaccgcagacgacucgcccga

SEQ ID NO: 8747 - RNA, 51 nt, Artificial Sequence
  Description of Artificial Sequence: Synthetic oligonucleotide
gggaggacgaugcggcccuuucguucucaccuccccagacgacucgcccga

SEQ ID NO: 8748 - RNA, 51 nt, Artificial Sequence
  Description of Artificial Sequence: Synthetic oligonucleotide
gggaggacgaugcgguuugaaaggugguggguccgcagacgacucgcccga

SEQ ID NO: 8749 - RNA, 51 nt, Artificial Sequence
  Description of Artificial Sequence: Synthetic oligonucleotide
gggaggacgaugcggguuggguguagggaguuccgcagacgacucgcccga

SEQ ID NO: 8750 - RNA, 51 nt, Artificial Sequence
  Description of Artificial Sequence: Synthetic oligonucleotide
gggaggacgaugcgguuugaauggugguggguccgcagacgacucgcccga

SEQ ID NO: 8751 - RNA, 51 nt, Artificial Sequence
  Description of Artificial Sequence: Synthetic oligonucleotide
gggaggacgaugcgguuggaaguagggugguaccgcagacgacucgcccga

SEQ ID NO: 8752 - RNA, 51 nt, Artificial Sequence
  Description of Artificial Sequence: Synthetic oligonucleotide
gggaggacgaugcggguuguagggugauggguccgcagacgacucgcccga

SEQ ID NO: 8753 - RNA, 51 nt, Artificial Sequence
  Description of Artificial Sequence: Synthetic oligonucleotide
gggaggacgaugcgguguaggaggaguagguaccgcagacgacucgcccga

SEQ ID NO: 8754 - RNA, 51 nt, Artificial Sequence
  Description of Artificial Sequence: Synthetic oligonucleotide
gggaggacgaugcggauuggugaacggagguacugcagacgacucgcccga

SEQ ID NO: 8755 - RNA, 51 nt, Artificial Sequence
  Description of Artificial Sequence: Synthetic oligonucleotide
gggaggacgaugcggagagcgagaaucuggugcaccagacgacucgcccga

SEQ ID NO: 8756 - RNA, 51 nt, Artificial Sequence
  Description of Artificial Sequence: Synthetic oligonucleotide
gggaggacgaugcggaauaguccuugccuugugcccagacgacucgcccga

SEQ ID NO: 8757 - RNA, 51 nt, Artificial Sequence
  Description of Artificial Sequence: Synthetic oligonucleotide
gggaggacgaugcggugaucuucuggguaccaccccagacgacucgcccga

SEQ ID NO: 8758 - RNA, 51 nt, Artificial Sequence
  Description of Artificial Sequence: Synthetic oligonucleotide
gggaggacgaugcgguguaguggguacgucgugugcagacgacucgcccga

SEQ ID NO: 8759 - RNA, 51 nt, Artificial Sequence
  Description of Artificial Sequence: Synthetic oligonucleotide
gggaggacgaugcggcaccuuaucuuuggugaccccagacgacucgcccga

SEQ ID NO: 8760 - RNA, 51 nt, Artificial Sequence
  Description of Artificial Sequence: Synthetic oligonucleotide
gggaggacgaugcggacgacaguccucugcgcgugcagacgacucgcccga

SEQ ID NO: 8761 - RNA, 51 nt, Artificial Sequence
  Description of Artificial Sequence: Synthetic oligonucleotide
gggaggacgaugcggugugaucgucuguuccuccacagacgacucgcccga

SEQ ID NO: 8762 - RNA, 51 nt, Artificial Sequence
  Description of Artificial Sequence: Synthetic oligonucleotide
gggaggacgaugcgguuagaguauguugggugcugcagacgacucgcccga

SEQ ID NO: 8763 - RNA, 51 nt, Artificial Sequence
  Description of Artificial Sequence: Synthetic oligonucleotide
gggaggacgaugcgguucgggccauccugcgugugcagacgacucgcccga

SEQ ID NO: 8764 - RNA, 51 nt, Artificial Sequence
  Description of Artificial Sequence: Synthetic oligonucleotide
gggaggacgaugcggcucugauggaggaggguggacagacgacucgcccga

SEQ ID NO: 8765 - RNA, 51 nt, Artificial Sequence
  Description of Artificial Sequence: Synthetic oligonucleotide
gggaggacgaugcggugaguucguacugucggccccagacgacucgcccga

SEQ ID NO: 8766 - RNA, 51 nt, Artificial Sequence
  Description of Artificial Sequence: Synthetic oligonucleotide
gggaggacgaugcggucguuccugucgucguggugcagacgacucgcccga

SEQ ID NO: 8767 - RNA, 51 nt, Artificial Sequence
  Description of Artificial Sequence: Synthetic oligonucleotide
gggaggacgaugcggcaucaguauacuccccacugcagacgacucgcccga

SEQ ID NO: 8768 - RNA, 51 nt, Artificial Sequence
  Description of Artificial Sequence: Synthetic oligonucleotide
gggaggacgaugcgguccgucaugucguuaugcugcagacgacucgcccga

SEQ ID NO: 8769 - RNA, 51 nt, Artificial Sequence
  Description of Artificial Sequence: Synthetic oligonucleotide
gggaggacgaugcggucccucugucgugugcuguccagacgacucgcccga

SEQ ID NO: 8770 - RNA, 51 nt, Artificial Sequence
  Description of Artificial Sequence: Synthetic oligonucleotide
gggaggacgaugcggaacagucacuggcuugccgccagacgacucgcccga

SEQ ID NO: 8771 - RNA, 51 nt, Artificial Sequence
  Description of Artificial Sequence: Synthetic oligonucleotide
gggaggacgaugcggcagaaggccaacugcaugugcagacgacucgcccga

SEQ ID NO: 8772 - RNA, 51 nt, Artificial Sequence
  Description of Artificial Sequence: Synthetic oligonucleotide
gggaggacgaugcggguuagucuaugcgcggugcccagacgacucgcccga

SEQ ID NO: 8773 - RNA, 51 nt, Artificial Sequence
  Description of Artificial Sequence: Synthetic oligonucleotide
gggaggacgaugcgggacuguccuucgucguggugcagacgacucgcccga

SEQ ID NO: 8774 - RNA, 51 nt, Artificial Sequence
  Description of Artificial Sequence: Synthetic oligonucleotide
gggaggacgaugcgguccuuccgucguuugugccccagacgacucgcccga

SEQ ID NO: 8775 - RNA, 51 nt, Artificial Sequence
  Description of Artificial Sequence: Synthetic oligonucleotide
gggaggacgaugcgguugggcguagggugguacugcagacgacucgcccga

SEQ ID NO: 8776 - RNA, 50 nt, Artificial Sequence
  Description of Artificial Sequence: Synthetic oligonucleotide
gggaggacgaugcggugcgacacuauuuuggcugcagacgacucgcccga

SEQ ID NO: 8777 - RNA, 51 nt, Artificial Sequence
  Description of Artificial Sequence: Synthetic oligonucleotide
gggaggacgaugcgguuucgucuccccuacgugcccagacgacucgcccga

SEQ ID NO: 8778 - RNA, 51 nt, Artificial Sequence
  Description of Artificial Sequence: Synthetic oligonucleotide
gggaggacgaugcggaccgacacgucuuccauggccagacgacucgcccga

SEQ ID NO: 8779 - RNA, 51 nt, Artificial Sequence
  Description of Artificial Sequence: Synthetic oligonucleotide
gggaggacgaugcggucuaggaggaggagguaccgcagacgacucgcccga

SEQ ID NO: 8780 - RNA, 51 nt, Artificial Sequence
  Description of Artificial Sequence: Synthetic oligonucleotide
gggaggacgaugcggucacagauccuccuuguggccagacgacucgcccga

SEQ ID NO: 8781 - RNA, 51 nt, Artificial Sequence
  Description of Artificial Sequence: Synthetic oligonucleotide
gggaggacgaugcgguuugaagggagacggguccgcagacgacucgcccga

SEQ ID NO: 8782 - RNA, 51 nt, Artificial Sequence
  Description of Artificial Sequence: Synthetic oligonucleotide
gggaggacgaugcgguaggucgcugcgccguugugcagacgacucgcccga

SEQ ID NO: 8783 - RNA, 50 nt, Artificial Sequence
  Description of Artificial Sequence: Synthetic oligonucleotide
gggaggacgaugcggaggcccaugucgucgugugcagacgacucgcccga

SEQ ID NO: 8784 - RNA, 50 nt, Artificial Sequence
  Description of Artificial Sequence: Synthetic oligonucleotide
gggaggacgaugcgguuggagggugauggguccgcagacgacucgcccga

SEQ ID NO: 8785 - RNA, 51 nt, Artificial Sequence
  Description of Artificial Sequence: Synthetic oligonucleotide
gggaggacgaugcgguugggagggggauggguccgcagacgacucgcccga

SEQ ID NO: 8786 - RNA, 51 nt, Artificial Sequence
  Description of Artificial Sequence: Synthetic oligonucleotide
gggaggacgaugcgguccugucgucuguugguccccagacgacucgcccga

SEQ ID NO: 8787 - RNA, 51 nt, Artificial Sequence
  Description of Artificial Sequence: Synthetic oligonucleotide
gggaggacgaugcggaaccucaucuuaacgugccccagacgacucgcccga

SEQ ID NO: 8788 - RNA, 51 nt, Artificial Sequence
  Description of Artificial Sequence: Synthetic oligonucleotide
gggaggacgaugcgguaucccaaaaugccccaccgcagacgacucgcccga

SEQ ID NO: 8789 - RNA, 51 nt, Artificial Sequence
  Description of Artificial Sequence: Synthetic oligonucleotide
gggaggacgaugcggugucgaacgguguuuaucgccagacgacucgcccga

SEQ ID NO: 8790 - RNA, 51 nt, Artificial Sequence
  Description of Artificial Sequence: Synthetic oligonucleotide
gggaggacgaugcgguuugaagggagaaggguccgcagacgacucgcccga

SEQ ID NO: 8791 - RNA, 51 nt, Artificial Sequence
  Description of Artificial Sequence: Synthetic oligonucleotide
gggaggacgaugcggucuucucggcgcucguugugcagacgacucgcccga

SEQ ID NO: 8792 - RNA, 51 nt, Artificial Sequence
  Description of Artificial Sequence: Synthetic oligonucleotide
gggaggacgaugcgguuugaauggggguguagggucagacgacucgcccga

SEQ ID NO: 8793 - RNA, 51 nt, Artificial Sequence
  Description of Artificial Sequence: Synthetic oligonucleotide
gggaggacgaugcgguuugaagggugaagggaccgcagacgacucgcccga

SEQ ID NO: 8794 - RNA, 51 nt, Artificial Sequence
  Description of Artificial Sequence: Synthetic oligonucleotide
gggaggacgaugcgguuuggggggugauggguccgcagacgacucgcccga

SEQ ID NO: 8795 - RNA, 51 nt, Artificial Sequence
  Description of Artificial Sequence: Synthetic oligonucleotide
gggaggacgaugcgguauuggagguguauggaccgcagacgacucgcccga

SEQ ID NO: 8796 - RNA, 51 nt, Artificial Sequence
  Description of Artificial Sequence: Synthetic oligonucleotide
gggaggacgaugcgguguaggaggaggagguaccucagacgacucgcccga

SEQ ID NO: 8797 - RNA, 51 nt, Artificial Sequence
  Description of Artificial Sequence: Synthetic oligonucleotide
gggaggacgaugcggguccugucgucuuucguccccagacgacucgcccga

SEQ ID NO: 8798 - RNA, 51 nt, Artificial Sequence
  Description of Artificial Sequence: Synthetic oligonucleotide
gggaggacgaugcggauuggugaagggauguaccgcagacgacucgcccga

SEQ ID NO: 8799 - RNA, 51 nt, Artificial Sequence
  Description of Artificial Sequence: Synthetic oligonucleotide
gggaggacgaugcgguuugaagggagauggauccgcagacgacucgcccga

SEQ ID NO: 8800 - RNA, 51 nt, Artificial Sequence
  Description of Artificial Sequence: Synthetic oligonucleotide
gggaggacgaugcggagugagcucgucuauggccccagacgacucgcccga

SEQ ID NO: 8801 - RNA, 51 nt, Artificial Sequence
  Description of Artificial Sequence: Synthetic oligonucleotide
gggaggacgaugcggauuggaggagggugggacugcagacgacucgcccga

SEQ ID NO: 8802 - RNA, 51 nt, Artificial Sequence
  Description of Artificial Sequence: Synthetic oligonucleotide
gggaggacgaugcgguuugaauggggauggguccgcagacgacucgcccga

SEQ ID NO: 8803 - RNA, 51 nt, Artificial Sequence
  Description of Artificial Sequence: Synthetic oligonucleotide
gggaggacgaugcgguuuggaguggggugggaccgcagacgacucgcccga

SEQ ID NO: 8804 - RNA, 51 nt, Artificial Sequence
  Description of Artificial Sequence: Synthetic oligonucleotide
gggaggacgaugcgguuugaagggugcugggcccgcagacgacucgcccga

SEQ ID NO: 8805 - RNA, 51 nt, Artificial Sequence
  Description of Artificial Sequence: Synthetic oligonucleotide
gggaggacgaugcgguugggaggaggaugguaccgcagacgacucgcccga

SEQ ID NO: 8806 - RNA, 51 nt, Artificial Sequence
  Description of Artificial Sequence: Synthetic oligonucleotide
gggaggacgaugcggccacguugucugcgacugugcagacgacucgcccga

SEQ ID NO: 8807 - RNA, 51 nt, Artificial Sequence
  Description of Artificial Sequence: Synthetic oligonucleotide
gggaggacgaugcgguagcuuuacccugcaagcuacagacgacucgcccga

SEQ ID NO: 8808 - RNA, 51 nt, Artificial Sequence
  Description of Artificial Sequence: Synthetic oligonucleotide
gggaggacgaugcggcauaauacuccugucguguacagacgacucgcccga

SEQ ID NO: 8809 - RNA, 51 nt, Artificial Sequence
  Description of Artificial Sequence: Synthetic oligonucleotide
gggaggacgaugcgggugcugucgaucuucguccccagacgacucgcccga

SEQ ID NO: 8810 - RNA, 51 nt, Artificial Sequence
  Description of Artificial Sequence: Synthetic oligonucleotide
gggaggacgaugcggcaucguuuucgucgcguuaccagacgacucgcccga

SEQ ID NO: 8811 - RNA, 50 nt, Artificial Sequence
  Description of Artificial Sequence: Synthetic oligonucleotide
gggaggacgaugcgggccuuucguucgcccuccccagacgacucgcccga

SEQ ID NO: 8812 - RNA, 51 nt, Artificial Sequence
  Description of Artificial Sequence: Synthetic oligonucleotide
gggaggacgaugcggucuucaccugccgucgugugcagacgacucgcccga

SEQ ID NO: 8813 - RNA, 51 nt, Artificial Sequence
  Description of Artificial Sequence: Synthetic oligonucleotide
gggaggacgaugcgguuugaagggugauggcuccccagacgacucgcccga

SEQ ID NO: 8814 - RNA, 51 nt, Artificial Sequence
  Description of Artificial Sequence: Synthetic oligonucleotide
gggaggacgaugcggaucgaucuaaucccggucgccagacgacucgcccga

SEQ ID NO: 8815 - RNA, 51 nt, Artificial Sequence
  Description of Artificial Sequence: Synthetic oligonucleotide
gggaggacgaugcgguccuguuccucucgugucggcagacgacucgcccga

SEQ ID NO: 8816 - RNA, 51 nt, Artificial Sequence
  Description of Artificial Sequence: Synthetic oligonucleotide
gggaggacgaugcggcauugucuuaugucgugugccagacgacucgcccga

SEQ ID NO: 8817 - RNA, 51 nt, Artificial Sequence
  Description of Artificial Sequence: Synthetic oligonucleotide
gggaggacgaugcgguccccugauugucguuugugcagacgacucgcccga

SEQ ID NO: 8818 - RNA, 51 nt, Artificial Sequence
  Description of Artificial Sequence: Synthetic oligonucleotide
gggaggacgaugcgggccuuucguucucuccuccccagacgacucgcccga

SEQ ID NO: 8819 - RNA, 51 nt, Artificial Sequence
  Description of Artificial Sequence: Synthetic oligonucleotide
gggaggacgaugcgguguccuucauuaggccgcaccagacgacucgcccga

SEQ ID NO: 8820 - RNA, 51 nt, Artificial Sequence
  Description of Artificial Sequence: Synthetic oligonucleotide
gggaggacgaugcggucugguucuccugcucgcugcagacgacucgcccga

SEQ ID NO: 8821 - RNA, 51 nt, Artificial Sequence
  Description of Artificial Sequence: Synthetic oligonucleotide
gggaggacgaugcggaaagucggcucuggugugcccagacgacucgcccga

SEQ ID NO: 8822 - RNA, 51 nt, Artificial Sequence
  Description of Artificial Sequence: Synthetic oligonucleotide
gggaggacgaugcggacaccauuacuucgccaccccagacgacucgcccga

SEQ ID NO: 8823 - RNA, 51 nt, Artificial Sequence
  Description of Artificial Sequence: Synthetic oligonucleotide
gggaggacgaugcgguccugugucuccacguacugcagacgacucgcccga

SEQ ID NO: 8824 - RNA, 51 nt, Artificial Sequence
  Description of Artificial Sequence: Synthetic oligonucleotide
gggaggacgaugcggugagucguaauuugccgcgucagacgacucgcccga

SEQ ID NO: 8825 - RNA, 49 nt, Artificial Sequence
  Description of Artificial Sequence: Synthetic oligonucleotide
gggaggacgaugcggauugguagggagguacugcagacgacucgcccga

SEQ ID NO: 8826 - RNA, 51 nt, Artificial Sequence
  Description of Artificial Sequence: Synthetic oligonucleotide
gggaggacgaugcggugaguaccuccguucguguccagacgacucgcccga

SEQ ID NO: 8827 - RNA, 51 nt, Artificial Sequence
  Description of Artificial Sequence: Synthetic oligonucleotide
gggaggacgaugcgguccccaugugucuucugugccagacgacucgcccga

SEQ ID NO: 8828 - RNA, 50 nt, Artificial Sequence
  Description of Artificial Sequence: Synthetic oligonucleotide
gggaggacgaugcgguaaagugcggguucguguccagacgacucgcccga

SEQ ID NO: 8829 - RNA, 51 nt, Artificial Sequence
  Description of Artificial Sequence: Synthetic oligonucleotide
gggaggacgaugcgguuagucguguucugucgcugcagacgacucgcccga

SEQ ID NO: 8830 - RNA, 51 nt, Artificial Sequence
  Description of Artificial Sequence: Synthetic oligonucleotide
gggaggacgaugcggcgcuuccucugguucguccccagacgacucgcccga

SEQ ID NO: 8831 - RNA, 51 nt, Artificial Sequence
  Description of Artificial Sequence: Synthetic oligonucleotide
gggaggacgaugcggugagucugacgacugugcgccagacgacucgcccga

SEQ ID NO: 8832 - RNA, 51 nt, Artificial Sequence
  Description of Artificial Sequence: Synthetic oligonucleotide
gggaggacgaugcggauugaccucuaucccgugcccagacgacucgcccga

SEQ ID NO: 8833 - RNA, 51 nt, Artificial Sequence
  Description of Artificial Sequence: Synthetic oligonucleotide
gggaggacgaugcggcccguccuuccucguuugcccagacgacucgcccga

SEQ ID NO: 8834 - RNA, 51 nt, Artificial Sequence
  Description of Artificial Sequence: Synthetic oligonucleotide
gggaggacgaugcggucugaagggcgauggguccgcagacgacucgcccga

SEQ ID NO: 8835 - RNA, 49 nt, Artificial Sequence
  Description of Artificial Sequence: Synthetic oligonucleotide
gggaggacgaugcgguuugaagggugaucuccgcagacgacucgcccga

SEQ ID NO: 8836 - RNA, 51 nt, Artificial Sequence
  Description of Artificial Sequence: Synthetic oligonucleotide
gggaggacgaugcgguuugaugggagauggguccgcagacgacucgcccga

SEQ ID NO: 8837 - RNA, 50 nt, Artificial Sequence
  Description of Artificial Sequence: Synthetic oligonucleotide
gggaggacgaugcgguguguagucuauccgcccgcagacgacucgcccga

SEQ ID NO: 8838 - RNA, 51 nt, Artificial Sequence
  Description of Artificial Sequence: Synthetic oligonucleotide
gggaggacgaugcgguuugaagugggaugggaccgcagacgacucgcccga

SEQ ID NO: 8839 - RNA, 51 nt, Artificial Sequence
  Description of Artificial Sequence: Synthetic oligonucleotide
gggaggacgaugcgggccuuucgugcugaccuccccagacgacucgcccga

SEQ ID NO: 8840 - RNA, 51 nt, Artificial Sequence
  Description of Artificial Sequence: Synthetic oligonucleotide
gggaggacgaugcggcauugucucccgucggugugcagacgacucgcccga

SEQ ID NO: 8841 - RNA, 51 nt, Artificial Sequence
  Description of Artificial Sequence: Synthetic oligonucleotide
gggaggacgaugcgguccugucgucuguacguccccagacgacucgcccga

SEQ ID NO: 8842 - RNA, 51 nt, Artificial Sequence
  Description of Artificial Sequence: Synthetic oligonucleotide
gggaggacgaugcggauggguugucuuaccggugccagacgacucgcccga

SEQ ID NO: 8843 - RNA, 51 nt, Artificial Sequence
  Description of Artificial Sequence: Synthetic oligonucleotide
gggaggacgaugcggguccugugucuguucguccccagacgacucgcccga

SEQ ID NO: 8844 - RNA, 51 nt, Artificial Sequence
  Description of Artificial Sequence: Synthetic oligonucleotide
gggaggacgaugcgguuugaagugagauggguccgcagacgacucgcccga

SEQ ID NO: 8845 - RNA, 51 nt, Artificial Sequence
  Description of Artificial Sequence: Synthetic oligonucleotide
gggaggacgaugcgguuugaagggaaauggguccgcagacgacucgcccga

SEQ ID NO: 8846 - RNA, 51 nt, Artificial Sequence
  Description of Artificial Sequence: Synthetic oligonucleotide
gggaggacgaugcggauagggggaagggugaaccgcagacgacucgcccga

SEQ ID NO: 8847 - RNA, 51 nt, Artificial Sequence
  Description of Artificial Sequence: Synthetic oligonucleotide
gggaggacgaugcgguguaugaggaggagguaccgcagacgacucgcccga

SEQ ID NO: 8848 - RNA, 50 nt, Artificial Sequence
  Description of Artificial Sequence: Synthetic oligonucleotide
gggaggacgaugcgguuggguguaggguggaccgcagacgacucgcccga

SEQ ID NO: 8849 - RNA, 50 nt, Artificial Sequence
  Description of Artificial Sequence: Synthetic oligonucleotide
gggaggacgaugcggguggguguaggguguaccgcagacgacucgcccga

SEQ ID NO: 8850 - RNA, 51 nt, Artificial Sequence
  Description of Artificial Sequence: Synthetic oligonucleotide
gggaggacgaugcgguuugaagggagaugaguccgcagacgacucgcccga

SEQ ID NO: 8851 - RNA, 51 nt, Artificial Sequence
  Description of Artificial Sequence: Synthetic oligonucleotide
gggaggacgaugcgguuugaagggcgauggauccgcagacgacucgcccga

SEQ ID NO: 8852 - RNA, 50 nt, Artificial Sequence
  Description of Artificial Sequence: Synthetic oligonucleotide
gggaggacgaugcgguugaagggggauggguccgcagacgacucgcccga

SEQ ID NO: 8853 - RNA, 51 nt, Artificial Sequence
  Description of Artificial Sequence: Synthetic oligonucleotide
gggaggacgaugcgguuuggaggaggguggguccgcagacgacucgcccga

SEQ ID NO: 8854 - RNA, 51 nt, Artificial Sequence
  Description of Artificial Sequence: Synthetic oligonucleotide
gggaggacgaugcgguguagggagguaguuaucgccagacgacucgcccga

SEQ ID NO: 8855 - RNA, 51 nt, Artificial Sequence
  Description of Artificial Sequence: Synthetic oligonucleotide
gggaggacgaugcgggucguuuguuaaguggccgccagacgacucgcccga

SEQ ID NO: 8856 - RNA, 51 nt, Artificial Sequence
  Description of Artificial Sequence: Synthetic oligonucleotide
gggaggacgaugcgguaucgucaguucuccugcgccagacgacucgcccga

SEQ ID NO: 8857 - RNA, 51 nt, Artificial Sequence
  Description of Artificial Sequence: Synthetic oligonucleotide
gggaggacgaugcggugaguuuguuuagcuggccccagacgacucgcccga

SEQ ID NO: 8858 - RNA, 51 nt, Artificial Sequence
  Description of Artificial Sequence: Synthetic oligonucleotide
gggaggacgaugcggcuuucgucuccugucgugcacagacgacucgcccga

SEQ ID NO: 8859 - RNA, 51 nt, Artificial Sequence
  Description of Artificial Sequence: Synthetic oligonucleotide
gggaggacgaugcgguaguccuaugucguaugcugcagacgacucgcccga

SEQ ID NO: 8860 - RNA, 51 nt, Artificial Sequence
  Description of Artificial Sequence: Synthetic oligonucleotide
gggaggacgaugcgguaugggaguaggguggcacgcagacgacucgcccga

SEQ ID NO: 8861 - RNA, 51 nt, Artificial Sequence
  Description of Artificial Sequence: Synthetic oligonucleotide
gggaggacgaugcggcguuuccucugguucgucgccagacgacucgcccga

SEQ ID NO: 8862 - RNA, 50 nt, Artificial Sequence
  Description of Artificial Sequence: Synthetic oligonucleotide
gggaggacgaugcggguugguucgucuccguguacagacgacucgcccga

SEQ ID NO: 8863 - RNA, 51 nt, Artificial Sequence
  Description of Artificial Sequence: Synthetic oligonucleotide
gggaggacgaugcggucuuucuccuccugucgcugcagacgacucgcccga

SEQ ID NO: 8864 - RNA, 51 nt, Artificial Sequence
  Description of Artificial Sequence: Synthetic oligonucleotide
gggaggacgaugcgggaacaacuuacuucccuggccagacgacucgcccga

SEQ ID NO: 8865 - RNA, 51 nt, Artificial Sequence
  Description of Artificial Sequence: Synthetic oligonucleotide
gggaggacgaugcgguaggucuggugcagugugugcagacgacucgcccga

SEQ ID NO: 8866 - RNA, 51 nt, Artificial Sequence
  Description of Artificial Sequence: Synthetic oligonucleotide
gggaggacgaugcggccgcauuguucgucuguguccagacgacucgcccga

SEQ ID NO: 8867 - RNA, 51 nt, Artificial Sequence
  Description of Artificial Sequence: Synthetic oligonucleotide
gggaggacgaugcggugcgaacucuggggucugugcagacgacucgcccga

SEQ ID NO: 8868 - RNA, 51 nt, Artificial Sequence
  Description of Artificial Sequence: Synthetic oligonucleotide
gggaggacgaugcggcacccuuuauacugcaagggcagacgacucgcccga

SEQ ID NO: 8869 - RNA, 49 nt, Artificial Sequence
  Description of Artificial Sequence: Synthetic oligonucleotide
gggaggacgaugcgguuguguagggugguaccgcagacgacucgcccga

SEQ ID NO: 8870 - RNA, 51 nt, Artificial Sequence
  Description of Artificial Sequence: Synthetic oligonucleotide
gggaggacgaugcgguacuuuauccugcaagugaccagacgacucgcccga

SEQ ID NO: 8871 - RNA, 50 nt, Artificial Sequence
  Description of Artificial Sequence: Synthetic oligonucleotide
gggaggacgaugcgggccuuucguucugccuucccagacgacucgcccga

SEQ ID NO: 8872 - RNA, 51 nt, Artificial Sequence
  Description of Artificial Sequence: Synthetic oligonucleotide
gggaggacgaugcgguagagucggacucuggucgccagacgacucgcccga

SEQ ID NO: 8873 - RNA, 51 nt, Artificial Sequence
  Description of Artificial Sequence: Synthetic oligonucleotide
gggaggacgaugcggcauugucccgacauuauccgcagacgacucgcccga

SEQ ID NO: 8874 - RNA, 51 nt, Artificial Sequence
  Description of Artificial Sequence: Synthetic oligonucleotide
gggaggacgaugcggauggguucgcugcaguugugcagacgacucgcccga

SEQ ID NO: 8875 - RNA, 51 nt, Artificial Sequence
  Description of Artificial Sequence: Synthetic oligonucleotide
gggaggacgaugcgguuggguguaaagugguaccgcagacgacucgcccga

SEQ ID NO: 8876 - RNA, 51 nt, Artificial Sequence
  Description of Artificial Sequence: Synthetic oligonucleotide
gggaggacgaugcggacggguuaaccugguuacgccagacgacucgcccga

SEQ ID NO: 8877 - RNA, 51 nt, Artificial Sequence
  Description of Artificial Sequence: Synthetic oligonucleotide
gggaggacgaugcggagagacuacggauucgcgugcagacgacucgcccga

SEQ ID NO: 8878 - RNA, 51 nt, Artificial Sequence
  Description of Artificial Sequence: Synthetic oligonucleotide
gggaggacgaugcggguguagugaauguguggccccagacgacucgcccga

SEQ ID NO: 8879 - RNA, 51 nt, Artificial Sequence
  Description of Artificial Sequence: Synthetic oligonucleotide
gggaggacgaugcggugcgaagggugauggguccgcagacgacucgcccga

SEQ ID NO: 8880 - RNA, 51 nt, Artificial Sequence
  Description of Artificial Sequence: Synthetic oligonucleotide
gggaggacgaugcgguuaguccuaucguuuggcaccagacgacucgcccga

SEQ ID NO: 8881 - RNA, 51 nt, Artificial Sequence
  Description of Artificial Sequence: Synthetic oligonucleotide
gggaggacgaugcggugagguaugcucugcgugugcagacgacucgcccga

SEQ ID NO: 8882 - RNA, 51 nt, Artificial Sequence
  Description of Artificial Sequence: Synthetic oligonucleotide
gggaggacgaugcggacaugucguucgccuuggugcagacgacucgcccga

SEQ ID NO: 8883 - RNA, 51 nt, Artificial Sequence
  Description of Artificial Sequence: Synthetic oligonucleotide
gggaggacgaugcgggccuuucgguuugcccuccccagacgacucgcccga

SEQ ID NO: 8884 - RNA, 52 nt, Artificial Sequence
  Description of Artificial Sequence: Synthetic oligonucleotide
gggaggacgaugcggguccuaucgucuguucguccccagacgacucgcccga

SEQ ID NO: 8885 - RNA, 51 nt, Artificial Sequence
  Description of Artificial Sequence: Synthetic oligonucleotide
gggaggacgaugcggucccgucguugcgauuucgccagacgacucgcccga

SEQ ID NO: 8886 - RNA, 51 nt, Artificial Sequence
  Description of Artificial Sequence: Synthetic oligonucleotide
gggaggacgaugcggaaauucgucuccccguugugcagacgacucgcccga

SEQ ID NO: 8887 - RNA, 51 nt, Artificial Sequence
  Description of Artificial Sequence: Synthetic oligonucleotide
gggaggacgaugcggacuguguauagacacuggcccagacgacucgcccga

SEQ ID NO: 8888 - RNA, 51 nt, Artificial Sequence
  Description of Artificial Sequence: Synthetic oligonucleotide
gggaggacgaugcgguauuggagguggagggaccgcagacgacucgcccga

SEQ ID NO: 8889 - RNA, 52 nt, Artificial Sequence
  Description of Artificial Sequence: Synthetic oligonucleotide
gggaggacgaugcggauuggugaaagggagguacugcagacgacucgcccga

SEQ ID NO: 8890 - RNA, 52 nt, Artificial Sequence
  Description of Artificial Sequence: Synthetic oligonucleotide
gggaggacgaugcggauuuggugaagggagguacugcagacgacucgcccga

SEQ ID NO: 8891 - RNA, 51 nt, Artificial Sequence
  Description of Artificial Sequence: Synthetic oligonucleotide
gggaggacgaugcggauuggugaagggagguaccucagacgacucgcccga

SEQ ID NO: 8892 - RNA, 51 nt, Artificial Sequence
  Description of Artificial Sequence: Synthetic oligonucleotide
gggaggacgaugcggugagugucugcuuuccaccccagacgacucgcccga

SEQ ID NO: 8893 - RNA, 51 nt, Artificial Sequence
  Description of Artificial Sequence: Synthetic oligonucleotide
gggaggacgaugcggguggagacuacauguggcgccagacgacucgcccga

SEQ ID NO: 8894 - RNA, 51 nt, Artificial Sequence
  Description of Artificial Sequence: Synthetic oligonucleotide
gggaggacgaugcgguaaugcaguguuucgugccccagacgacucgcccga

SEQ ID NO: 8895 - RNA, 51 nt, Artificial Sequence
  Description of Artificial Sequence: Synthetic oligonucleotide
gggaggacgaugcggugucacuuuucacguggcugcagacgacucgcccga

SEQ ID NO: 8896 - RNA, 51 nt, Artificial Sequence
  Description of Artificial Sequence: Synthetic oligonucleotide
gggaggacgaugcgguccuucacugauucgcugugcagacgacucgcccga

SEQ ID NO: 8897 - RNA, 51 nt, Artificial Sequence
  Description of Artificial Sequence: Synthetic oligonucleotide
gggaggacgaugcggaagccuccguguuugcgcgccagacgacucgcccga

SEQ ID NO: 8898 - RNA, 51 nt, Artificial Sequence
  Description of Artificial Sequence: Synthetic oligonucleotide
gggaggacgaugcgguuugaagugugguggguccgcagacgacucgcccga

SEQ ID NO: 8899 - RNA, 51 nt, Artificial Sequence
  Description of Artificial Sequence: Synthetic oligonucleotide
gggaggacgaugcgguuugaagggggauggguccccagacgacucgcccga

SEQ ID NO: 8900 - RNA, 51 nt, Artificial Sequence
  Description of Artificial Sequence: Synthetic oligonucleotide
gggaggacgaugcgguguagggaggcaguuaucgucagacgacucgcccga

SEQ ID NO: 8901 - RNA, 51 nt, Artificial Sequence
  Description of Artificial Sequence: Synthetic oligonucleotide
gggaggacgaugcgguuggguggagggggguaccgcagacgacucgcccga

SEQ ID NO: 8902 - RNA, 49 nt, Artificial Sequence
  Description of Artificial Sequence: Synthetic oligonucleotide
gggaggacgaugcgggccucguucugaccuccccagacgacucgcccga

SEQ ID NO: 8903 - RNA, 51 nt, Artificial Sequence
  Description of Artificial Sequence: Synthetic oligonucleotide
gggaggacgaugcggaaccgagguccuucguaccccagacgacucgcccga

SEQ ID NO: 8904 - RNA, 51 nt, Artificial Sequence
  Description of Artificial Sequence: Synthetic oligonucleotide
gggaggacgaugcgguccgcgguuugucaccucaccagacgacucgcccga

SEQ ID NO: 8905 - RNA, 51 nt, Artificial Sequence
  Description of Artificial Sequence: Synthetic oligonucleotide
gggaggacgaugcgggugacuucccugguucucgccagacgacucgcccga

SEQ ID NO: 8906 - RNA, 51 nt, Artificial Sequence
  Description of Artificial Sequence: Synthetic oligonucleotide
gggaggacgaugcgguguccaaugaaugucugccccagacgacucgcccga

SEQ ID NO: 8907 - RNA, 51 nt, Artificial Sequence
  Description of Artificial Sequence: Synthetic oligonucleotide
gggaggacgaugcggauugaagggggaugggaccgcagacgacucgcccga

SEQ ID NO: 8908 - RNA, 51 nt, Artificial Sequence
  Description of Artificial Sequence: Synthetic oligonucleotide
gggaggacgaugcgguuugaaggguuguggguccgcagacgacucgcccga

SEQ ID NO: 8909 - RNA, 51 nt, Artificial Sequence
  Description of Artificial Sequence: Synthetic oligonucleotide
gggaggacgaugcgguuuggagggggaugggucugcagacgacucgcccga

SEQ ID NO: 8910 - RNA, 51 nt, Artificial Sequence
  Description of Artificial Sequence: Synthetic oligonucleotide
gggaggacgaugcgguuuggagaagggagguacugcagacgacucgcccga

SEQ ID NO: 8911 - RNA, 51 nt, Artificial Sequence
  Description of Artificial Sequence: Synthetic oligonucleotide
gggaggacgaugcgguuuuaagggugguggguccgcagacgacucgcccga

SEQ ID NO: 8912 - RNA, 51 nt, Artificial Sequence
  Description of Artificial Sequence: Synthetic oligonucleotide
gggaggacgaugcgguugggaggggggugguaccgcagacgacucgcccga

SEQ ID NO: 8913 - RNA, 51 nt, Artificial Sequence
  Description of Artificial Sequence: Synthetic oligonucleotide
gggaggacgaugcgguguaggaggaugagguaccgcagacgacucgcccga

SEQ ID NO: 8914 - RNA, 51 nt, Artificial Sequence
  Description of Artificial Sequence: Synthetic oligonucleotide
gggaggacgaugcgguuugaagagggaugggaccgcagacgacucgcccga

SEQ ID NO: 8915 - RNA, 51 nt, Artificial Sequence
  Description of Artificial Sequence: Synthetic oligonucleotide
gggaggacgaugcgguuugaagggagauggguacgcagacgacucgcccga

SEQ ID NO: 8916 - RNA, 51 nt, Artificial Sequence
  Description of Artificial Sequence: Synthetic oligonucleotide
gggaggacgaugcggacaggucguucugacuccaccagacgacucgcccga

SEQ ID NO: 8917 - RNA, 51 nt, Artificial Sequence
  Description of Artificial Sequence: Synthetic oligonucleotide
gggaggacgaugcggucgaguccucaucugugcugcagacgacucgcccga

SEQ ID NO: 8918 - RNA, 51 nt, Artificial Sequence
  Description of Artificial Sequence: Synthetic oligonucleotide
gggaggacgaugcgggucuucugucuuaucguccccagacgacucgcccga

SEQ ID NO: 8919 - RNA, 51 nt, Artificial Sequence
  Description of Artificial Sequence: Synthetic oligonucleotide
gggaggacgaugcggcaucgauccgucuacgugugcagacgacucgcccga

SEQ ID NO: 8920 - RNA, 51 nt, Artificial Sequence
  Description of Artificial Sequence: Synthetic oligonucleotide
gggaggacgaugcgguuaguguacaaucccugccccagacgacucgcccga

SEQ ID NO: 8921 - RNA, 51 nt, Artificial Sequence
  Description of Artificial Sequence: Synthetic oligonucleotide
gggaggacgaugcggguagacguccgcgcguugugcagacgacucgcccga

SEQ ID NO: 8922 - RNA, 51 nt, Artificial Sequence
  Description of Artificial Sequence: Synthetic oligonucleotide
gggaggacgaugcggucucucucgucgucacugugcagacgacucgcccga

SEQ ID NO: 8923 - RNA, 51 nt, Artificial Sequence
  Description of Artificial Sequence: Synthetic oligonucleotide
gggaggacgaugcggguugacucgucuccucuccccagacgacucgcccga

SEQ ID NO: 8924 - RNA, 51 nt, Artificial Sequence
  Description of Artificial Sequence: Synthetic oligonucleotide
gggaggacgaugcgggaucguacuuuccccgugcccagacgacucgcccga

SEQ ID NO: 8925 - RNA, 51 nt, Artificial Sequence
  Description of Artificial Sequence: Synthetic oligonucleotide
gggaggacgaugcggauccacauccucuuuguccgcagacgacucgcccga

SEQ ID NO: 8926 - RNA, 51 nt, Artificial Sequence
  Description of Artificial Sequence: Synthetic oligonucleotide
gggaggacgaugcgguuuuccuuugucgcuggcgccagacgacucgcccga

SEQ ID NO: 8927 - RNA, 51 nt, Artificial Sequence
  Description of Artificial Sequence: Synthetic oligonucleotide
gggaggacgaugcgguuccucaaaugucgugugugcagacgacucgcccga

SEQ ID NO: 8928 - RNA, 51 nt, Artificial Sequence
  Description of Artificial Sequence: Synthetic oligonucleotide
gggaggacgaugcggugccguuagaucgccuaccccagacgacucgcccga

SEQ ID NO: 8929 - RNA, 51 nt, Artificial Sequence
  Description of Artificial Sequence: Synthetic oligonucleotide
gggaggacgaugcggcacccuucauguugccugcccagacgacucgcccga

SEQ ID NO: 8930 - RNA, 51 nt, Artificial Sequence
  Description of Artificial Sequence: Synthetic oligonucleotide
gggaggacgaugcggugauucgucucauacguggccagacgacucgcccga

SEQ ID NO: 8931 - RNA, 51 nt, Artificial Sequence
  Description of Artificial Sequence: Synthetic oligonucleotide
gggaggacgaugcggacagaagucgucauugcccccagacgacucgcccga

SEQ ID NO: 8932 - RNA, 51 nt, Artificial Sequence
  Description of Artificial Sequence: Synthetic oligonucleotide
gggaggacgaugcggaaggcccucgucgucugcugcagacgacucgcccga

SEQ ID NO: 8933 - RNA, 51 nt, Artificial Sequence
  Description of Artificial Sequence: Synthetic oligonucleotide
gggaggacgaugcggcuaguuccuucucguguggccagacgacucgcccga

SEQ ID NO: 8934 - RNA, 51 nt, Artificial Sequence
  Description of Artificial Sequence: Synthetic oligonucleotide
gggaggacgaugcggcaaagucauccucgcgugugcagacgacucgcccga

SEQ ID NO: 8935 - RNA, 52 nt, Artificial Sequence
  Description of Artificial Sequence: Synthetic oligonucleotide
gggaggacgaugcggggccuuucguucugcccuccccagacgacucgcccga

SEQ ID NO: 8936 - RNA, 51 nt, Artificial Sequence
  Description of Artificial Sequence: Synthetic oligonucleotide
gggaggacgaugcggcuggguguagggugguacugcagacgacucgcccga

SEQ ID NO: 8937 - RNA, 51 nt, Artificial Sequence
  Description of Artificial Sequence: Synthetic oligonucleotide
gggaggacgaugcggucgcucguuaugucguugcacagacgacucgcccga

SEQ ID NO: 8938 - RNA, 51 nt, Artificial Sequence
  Description of Artificial Sequence: Synthetic oligonucleotide
gggaggacgaugcgguagguagugggacugugccccagacgacucgcccga

SEQ ID NO: 8939 - RNA, 49 nt, Artificial Sequence
  Description of Artificial Sequence: Synthetic oligonucleotide
gggaggacgaugcgggucuuggcuuaucguccccagacgacucgcccga

SEQ ID NO: 8940 - RNA, 51 nt, Artificial Sequence
  Description of Artificial Sequence: Synthetic oligonucleotide
gggaggacgaugcggcaaugauguccucucucccccagacgacucgcccga

SEQ ID NO: 8941 - RNA, 51 nt, Artificial Sequence
  Description of Artificial Sequence: Synthetic oligonucleotide
gggaggacgaugcggccgcggaauuguccccugugcagacgacucgcccga

SEQ ID NO: 8942 - RNA, 51 nt, Artificial Sequence
  Description of Artificial Sequence: Synthetic oligonucleotide
gggaggacgaugcggucacucacaauccuucaccgcagacgacucgcccga

SEQ ID NO: 8943 - RNA, 51 nt, Artificial Sequence
  Description of Artificial Sequence: Synthetic oligonucleotide
gggaggacgaugcggauccucuggucauguugcgccagacgacucgcccga

SEQ ID NO: 8944 - RNA, 51 nt, Artificial Sequence
  Description of Artificial Sequence: Synthetic oligonucleotide
gggaggacgaugcgguuugaauggcgauggguccgcagacgacucgcccga

SEQ ID NO: 8945 - RNA, 51 nt, Artificial Sequence
  Description of Artificial Sequence: Synthetic oligonucleotide
gggaggacgaugcgggcugcagaacauguggaccccagacgacucgcccga

SEQ ID NO: 8946 - RNA, 51 nt, Artificial Sequence
  Description of Artificial Sequence: Synthetic oligonucleotide
gggaggacgaugcgguaaugucuagucccggaccccagacgacucgcccga

SEQ ID NO: 8947 - RNA, 52 nt, Artificial Sequence
  Description of Artificial Sequence: Synthetic oligonucleotide
gggaggacgaugcgggauuggugaagggagguacugcagacgacucgcccga

SEQ ID NO: 8948 - RNA, 52 nt, Artificial Sequence
  Description of Artificial Sequence: Synthetic oligonucleotide
gggaggacgaugcggauuuuuuggagaagggaggugcagacgacucgcccga

SEQ ID NO: 8949 - RNA, 51 nt, Artificial Sequence
  Description of Artificial Sequence: Synthetic oligonucleotide
gggaggacgaugcggacggugucgugagcucugugcagacgacucgcccga

SEQ ID NO: 8950 - RNA, 51 nt, Artificial Sequence
  Description of Artificial Sequence: Synthetic oligonucleotide
gggaggacgaugcgguuuggagaagggugggaccgcagacgacucgcccga

SEQ ID NO: 8951 - RNA, 51 nt, Artificial Sequence
  Description of Artificial Sequence: Synthetic oligonucleotide
gggaggacgaugcgguguggucugguuagcucggccagacgacucgcccga

SEQ ID NO: 8952 - RNA, 50 nt, Artificial Sequence
  Description of Artificial Sequence: Synthetic oligonucleotide
gggaggacgaugcgguugaagggcgauggguccgcagacgacucgcccga

SEQ ID NO: 8953 - RNA, 51 nt, Artificial Sequence
  Description of Artificial Sequence: Synthetic oligonucleotide
gggaggacgaugcggacaaaaaccucccacgugcccagacgacucgcccga

SEQ ID NO: 8954 - RNA, 51 nt, Artificial Sequence
  Description of Artificial Sequence: Synthetic oligonucleotide
gggaggacgaugcggagucuggucaagccguugugcagacgacucgcccga

SEQ ID NO: 8955 - RNA, 51 nt, Artificial Sequence
  Description of Artificial Sequence: Synthetic oligonucleotide
gggaggacgaugcggaaccgcgugacuguaugccccagacgacucgcccga

SEQ ID NO: 8956 - RNA, 51 nt, Artificial Sequence
  Description of Artificial Sequence: Synthetic oligonucleotide
gggaggacgaugcgguuugggguuuucucgugccccagacgacucgcccga

SEQ ID NO: 8957 - RNA, 51 nt, Artificial Sequence
  Description of Artificial Sequence: Synthetic oligonucleotide
gggaggacgaugcgguccuggauugucguuguccccagacgacucgcccga

SEQ ID NO: 8958 - RNA, 50 nt, Artificial Sequence
  Description of Artificial Sequence: Synthetic oligonucleotide
gggaggacgaugcgggccuucguuuguucguccccagacgacucgcccga

SEQ ID NO: 8959 - RNA, 52 nt, Artificial Sequence
  Description of Artificial Sequence: Synthetic oligonucleotide
gggaggacgaugcggaauuggugaagggagguacugcagacgacucgcccga

SEQ ID NO: 8960 - RNA, 49 nt, Artificial Sequence
  Description of Artificial Sequence: Synthetic oligonucleotide
gggaggacgaugcgguggugaagggagguacugcagacgacucgcccga

SEQ ID NO: 8961 - RNA, 51 nt, Artificial Sequence
  Description of Artificial Sequence: Synthetic oligonucleotide
gggaggacgaugcgguuugacgggggauggguccgcagacgacucgcccga

SEQ ID NO: 8962 - RNA, 52 nt, Artificial Sequence
  Description of Artificial Sequence: Synthetic oligonucleotide
gggaggacgaugcgggccuuucguucugacccuccccagacgacucgcccga

SEQ ID NO: 8963 - RNA, 51 nt, Artificial Sequence
  Description of Artificial Sequence: Synthetic oligonucleotide
gggaggacgaugcggaccgucaaacgucugugcgccagacgacucgcccga

SEQ ID NO: 8964 - RNA, 51 nt, Artificial Sequence
  Description of Artificial Sequence: Synthetic oligonucleotide
gggaggacgaugcgguuccgcguccguuuccugugcagacgacucgcccga

SEQ ID NO: 8965 - RNA, 49 nt, Artificial Sequence
  Description of Artificial Sequence: Synthetic oligonucleotide
gggaggacgaugcggauuggugaagggguacugcagacgacucgcccga

SEQ ID NO: 8966 - RNA, 51 nt, Artificial Sequence
  Description of Artificial Sequence: Synthetic oligonucleotide
gggaggacgaugcggcgauaucgucguguuggugccagacgacucgcccga

SEQ ID NO: 8967 - RNA, 51 nt, Artificial Sequence
  Description of Artificial Sequence: Synthetic oligonucleotide
gggaggacgaugcggucaguugucuuggugcgcaccagacgacucgcccga

SEQ ID NO: 8968 - RNA, 51 nt, Artificial Sequence
  Description of Artificial Sequence: Synthetic oligonucleotide
gggaggacgaugcggagcgauguuuguuguguggccagacgacucgcccga

SEQ ID NO: 8969 - RNA, 50 nt, Artificial Sequence
  Description of Artificial Sequence: Synthetic oligonucleotide
gggaggacgaugcgguccuggcuugucguuuccccagacgacucgcccga

SEQ ID NO: 8970 - RNA, 51 nt, Artificial Sequence
  Description of Artificial Sequence: Synthetic oligonucleotide
gggaggacgaugcggucuguagauaacgucugccccagacgacucgcccga

SEQ ID NO: 8971 - RNA, 51 nt, Artificial Sequence
  Description of Artificial Sequence: Synthetic oligonucleotide
gggaggacgaugcggaaucggguuaucgucuuggccagacgacucgcccga

SEQ ID NO: 8972 - RNA, 50 nt, Artificial Sequence
  Description of Artificial Sequence: Synthetic oligonucleotide
gggaggacgaugcgguuggguguagggugguaugcagacgacucgcccga

SEQ ID NO: 8973 - RNA, 51 nt, Artificial Sequence
  Description of Artificial Sequence: Synthetic oligonucleotide
gggaggacgaugcgguuugaacggcgauggguccgcagacgacucgcccga

SEQ ID NO: 8974 - RNA, 51 nt, Artificial Sequence
  Description of Artificial Sequence: Synthetic oligonucleotide
gggaggacgaugcggguugagucugcguugcugcccagacgacucgcccga

SEQ ID NO: 8975 - RNA, 51 nt, Artificial Sequence
  Description of Artificial Sequence: Synthetic oligonucleotide
gggaggacgaugcggcauuuucuuccugucgugugcagacgacucgcccga

SEQ ID NO: 8976 - RNA, 51 nt, Artificial Sequence
  Description of Artificial Sequence: Synthetic oligonucleotide
gggaggacgaugcggaguaggugucgucuuguggccagacgacucgcccga

SEQ ID NO: 8977 - RNA, 51 nt, Artificial Sequence
  Description of Artificial Sequence: Synthetic oligonucleotide
gggaggacgaugcggucccugucgucuugcguccccagacgacucgcccga

SEQ ID NO: 8978 - RNA, 51 nt, Artificial Sequence
  Description of Artificial Sequence: Synthetic oligonucleotide
gggaggacgaugcgguuggguguagggcggugccgcagacgacucgcccga

SEQ ID NO: 8979 - RNA, 52 nt, Artificial Sequence
  Description of Artificial Sequence: Synthetic oligonucleotide
gggaggacgaugcgggucccgucgucuguucguccccagacgacucgcccga

SEQ ID NO: 8980 - RNA, 51 nt, Artificial Sequence
  Description of Artificial Sequence: Synthetic oligonucleotide
gggaggacgaugcggccaauuucuuccccgugcugcagacgacucgcccga

SEQ ID NO: 8981 - RNA, 51 nt, Artificial Sequence
  Description of Artificial Sequence: Synthetic oligonucleotide
gggaggacgaugcgguucgaagggagauggguccgcagacgacucgcccga

SEQ ID NO: 8982 - RNA, 51 nt, Artificial Sequence
  Description of Artificial Sequence: Synthetic oligonucleotide
gggaggacgaugcgguuugaagggggauggcuccgcagacgacucgcccga

SEQ ID NO: 8983 - RNA, 51 nt, Artificial Sequence
  Description of Artificial Sequence: Synthetic oligonucleotide
gggaggacgaugcgguuuuggagguguagggaccgcagacgacucgcccga

SEQ ID NO: 8984 - RNA, 51 nt, Artificial Sequence
  Description of Artificial Sequence: Synthetic oligonucleotide
gggaggacgaugcgguuugaaguagggugggaccgcagacgacucgcccga

SEQ ID NO: 8985 - RNA, 51 nt, Artificial Sequence
  Description of Artificial Sequence: Synthetic oligonucleotide
gggaggacgaugcgguugggaguaggguggcaccgcagacgacucgcccga

SEQ ID NO: 8986 - RNA, 50 nt, Artificial Sequence
  Description of Artificial Sequence: Synthetic oligonucleotide
gggaggacgaugcggauugguaagggagguaccgcagacgacucgcccga

SEQ ID NO: 8987 - RNA, 51 nt, Artificial Sequence
  Description of Artificial Sequence: Synthetic oligonucleotide
gggaggacgaugcgguuggggguaggguguuaccgcagacgacucgcccga

SEQ ID NO: 8988 - RNA, 51 nt, Artificial Sequence
  Description of Artificial Sequence: Synthetic oligonucleotide
gggaggacgaugcggauuggaggggggugggacugcagacgacucgcccga

SEQ ID NO: 8989 - RNA, 51 nt, Artificial Sequence
  Description of Artificial Sequence: Synthetic oligonucleotide
gggaggacgaugcgguuugaagggagaugggucagcagacgacucgcccga

SEQ ID NO: 8990 - RNA, 51 nt, Artificial Sequence
  Description of Artificial Sequence: Synthetic oligonucleotide
gggaggacgaugcgguuugaagggcgauggcuccgcagacgacucgcccga

SEQ ID NO: 8991 - RNA, 51 nt, Artificial Sequence
  Description of Artificial Sequence: Synthetic oligonucleotide
gggaggacgaugcgguuuguagggggauggguccgcagacgacucgcccga

SEQ ID NO: 8992 - RNA, 51 nt, Artificial Sequence
  Description of Artificial Sequence: Synthetic oligonucleotide
gggaggacgaugcgguuugaugggugguggguccgcagacgacucgcccga

SEQ ID NO: 8993 - RNA, 51 nt, Artificial Sequence
  Description of Artificial Sequence: Synthetic oligonucleotide
gggaggacgaugcgguuugaaggaggguggguccgcagacgacucgcccga

SEQ ID NO: 8994 - RNA, 51 nt, Artificial Sequence
  Description of Artificial Sequence: Synthetic oligonucleotide
gggaggacgaugcgguuuggagaggggugggaccgcagacgacucgcccga

SEQ ID NO: 8995 - RNA, 51 nt, Artificial Sequence
  Description of Artificial Sequence: Synthetic oligonucleotide
gggaggacgaugcgguuuggaguaggaugggaccgcagacgacucgcccga

SEQ ID NO: 8996 - RNA, 51 nt, Artificial Sequence
  Description of Artificial Sequence: Synthetic oligonucleotide
gggaggacgaugcgguuuguagggugguggguccgcagacgacucgcccga

SEQ ID NO: 8997 - RNA, 51 nt, Artificial Sequence
  Description of Artificial Sequence: Synthetic oligonucleotide
gggaggacgaugcggauagggagaagggcgaaccgcagacgacucgcccga

SEQ ID NO: 8998 - RNA, 51 nt, Artificial Sequence
  Description of Artificial Sequence: Synthetic oligonucleotide
gggaggacgaugcgguuugaagggagauguguccgcagacgacucgcccga

SEQ ID NO: 8999 - RNA, 51 nt, Artificial Sequence
  Description of Artificial Sequence: Synthetic oligonucleotide
gggaggacgaugcggccaacguucucucacgugugcagacgacucgcccga

SEQ ID NO: 9000 - RNA, 51 nt, Artificial Sequence
  Description of Artificial Sequence: Synthetic oligonucleotide
gggaggacgaugcgggaugucuagggauuuguccccagacgacucgcccga

SEQ ID NO: 9001 - RNA, 51 nt, Artificial Sequence
  Description of Artificial Sequence: Synthetic oligonucleotide
gggaggacgaugcgguuuggaguuuucccgugccccagacgacucgcccga

SEQ ID NO: 9002 - RNA, 50 nt, Artificial Sequence
  Description of Artificial Sequence: Synthetic oligonucleotide
gggaggacgaugcggucuucuucucccaugucgccagacgacucgcccga

SEQ ID NO: 9003 - RNA, 51 nt, Artificial Sequence
  Description of Artificial Sequence: Synthetic oligonucleotide
gggaggacgaugcggucaccuaugcuagggugccacagacgacucgcccga

SEQ ID NO: 9004 - RNA, 51 nt, Artificial Sequence
  Description of Artificial Sequence: Synthetic oligonucleotide
gggaggacgaugcgggcguuucguucugaccuccccagacgacucgcccga

SEQ ID NO: 9005 - RNA, 51 nt, Artificial Sequence
  Description of Artificial Sequence: Synthetic oligonucleotide
gggaggacgaugcgguuccucuguauugcgcaccccagacgacucgcccga

SEQ ID NO: 9006 - RNA, 51 nt, Artificial Sequence
  Description of Artificial Sequence: Synthetic oligonucleotide
gggaggacgaugcgguuggguguggggugguacugcagacgacucgcccga

SEQ ID NO: 9007 - RNA, 51 nt, Artificial Sequence
  Description of Artificial Sequence: Synthetic oligonucleotide
gggaggacgaugcggguaacgcgucugcacguguccagacgacucgcccga

SEQ ID NO: 9008 - RNA, 51 nt, Artificial Sequence
  Description of Artificial Sequence: Synthetic oligonucleotide
gggaggacgaugcggagagucgugcugauuccccccagacgacucgcccga

SEQ ID NO: 9009 - RNA, 51 nt, Artificial Sequence
  Description of Artificial Sequence: Synthetic oligonucleotide
gggaggacgaugcggagcgaguauguuuagugcugcagacgacucgcccga

SEQ ID NO: 9010 - RNA, 51 nt, Artificial Sequence
  Description of Artificial Sequence: Synthetic oligonucleotide
gggaggacgaugcggaucgguccacuuugcgugcccagacgacucgcccga

SEQ ID NO: 9011 - RNA, 51 nt, Artificial Sequence
  Description of Artificial Sequence: Synthetic oligonucleotide
gggaggacgaugcgggcuugucguucuccugucugcagacgacucgcccga

SEQ ID NO: 9012 - RNA, 49 nt, Artificial Sequence
  Description of Artificial Sequence: Synthetic oligonucleotide
gggaggacgaugcgguuuggggugauggguccgcagacgacucgcccga

SEQ ID NO: 9013 - RNA, 51 nt, Artificial Sequence
  Description of Artificial Sequence: Synthetic oligonucleotide
gggaggacgaugcggaauguccuuugcggucucgccagacgacucgcccga

SEQ ID NO: 9014 - RNA, 51 nt, Artificial Sequence
  Description of Artificial Sequence: Synthetic oligonucleotide
gggaggacgaugcggccgcacgguuauucccuccgcagacgacucgcccga

SEQ ID NO: 9015 - RNA, 53 nt, Artificial Sequence
  Description of Artificial Sequence: Synthetic oligonucleotide
gggaggacgaugcggcaaguggucuuacgguccaccccagacgacucgcccga

SEQ ID NO: 9016 - RNA, 51 nt, Artificial Sequence
  Description of Artificial Sequence: Synthetic oligonucleotide
gggaggacgaugcggauagucgagccucugugcgccagacgacucgcccga

SEQ ID NO: 9017 - RNA, 51 nt, Artificial Sequence
  Description of Artificial Sequence: Synthetic oligonucleotide
gggaggacgaugcgguccuucggucugcucaugcccagacgacucgcccga

SEQ ID NO: 9018 - RNA, 51 nt, Artificial Sequence
  Description of Artificial Sequence: Synthetic oligonucleotide
gggaggacgaugcggcguaucgacuugccccugugcagacgacucgcccga

SEQ ID NO: 9019 - RNA, 51 nt, Artificial Sequence
  Description of Artificial Sequence: Synthetic oligonucleotide
gggaggacgaugcggccugucguuuguacuguugccagacgacucgcccga

SEQ ID NO: 9020 - RNA, 51 nt, Artificial Sequence
  Description of Artificial Sequence: Synthetic oligonucleotide
gggaggacgaugcgguuagucgauugccaugugugcagacgacucgcccga

SEQ ID NO: 9021 - RNA, 51 nt, Artificial Sequence
  Description of Artificial Sequence: Synthetic oligonucleotide
gggaggacgaugcgguagagucguaaccguguccccagacgacucgcccga

SEQ ID NO: 9022 - RNA, 51 nt, Artificial Sequence
  Description of Artificial Sequence: Synthetic oligonucleotide
gggaggacgaugcgguccaacaccugaugucgcugcagacgacucgcccga

SEQ ID NO: 9023 - RNA, 51 nt, Artificial Sequence
  Description of Artificial Sequence: Synthetic oligonucleotide
gggaggacgaugcggaggcuagcugucugguugugcagacgacucgcccga

SEQ ID NO: 9024 - RNA, 51 nt, Artificial Sequence
  Description of Artificial Sequence: Synthetic oligonucleotide
gggaggacgaugcggugagaauggaucuggugggccagacgacucgcccga

SEQ ID NO: 9025 - RNA, 51 nt, Artificial Sequence
  Description of Artificial Sequence: Synthetic oligonucleotide
gggaggacgaugcgggcggauaaauggccuggguacagacgacucgcccga

SEQ ID NO: 9026 - RNA, 50 nt, Artificial Sequence
  Description of Artificial Sequence: Synthetic oligonucleotide
gggaggacgaugcggauuggugaaggagguaccgcagacgacucgcccga

SEQ ID NO: 9027 - RNA, 51 nt, Artificial Sequence
  Description of Artificial Sequence: Synthetic oligonucleotide
gggaggacgaugcgggugacuuuaugaguugugugcagacgacucgcccga

SEQ ID NO: 9028 - RNA, 51 nt, Artificial Sequence
  Description of Artificial Sequence: Synthetic oligonucleotide
gggaggacgaugcgggaugacggcguugucgcuaccagacgacucgcccga

SEQ ID NO: 9029 - RNA, 51 nt, Artificial Sequence
  Description of Artificial Sequence: Synthetic oligonucleotide
gggaggacgaugcgggugaucaguccucuggucugcagacgacucgcccga

SEQ ID NO: 9030 - RNA, 51 nt, Artificial Sequence
  Description of Artificial Sequence: Synthetic oligonucleotide
gggaggacgaugcgguuagucgaaggugugcgugccagacgacucgcccga

SEQ ID NO: 9031 - RNA, 51 nt, Artificial Sequence
  Description of Artificial Sequence: Synthetic oligonucleotide
gggaggacgaugcgguauguagucgucgugugcgccagacgacucgcccga

SEQ ID NO: 9032 - RNA, 51 nt, Artificial Sequence
  Description of Artificial Sequence: Synthetic oligonucleotide
gggaggacgaugcggcagaggagguggugacaccgcagacgacucgcccga

SEQ ID NO: 9033 - RNA, 51 nt, Artificial Sequence
  Description of Artificial Sequence: Synthetic oligonucleotide
gggaggacgaugcggcuugucgucuccuuucaccccagacgacucgcccga

SEQ ID NO: 9034 - RNA, 51 nt, Artificial Sequence
  Description of Artificial Sequence: Synthetic oligonucleotide
gggaggacgaugcgggccugucguucugaccuccccagacgacucgcccga

SEQ ID NO: 9035 - RNA, 51 nt, Artificial Sequence
  Description of Artificial Sequence: Synthetic oligonucleotide
gggaggacgaugcggauccugccuugucguuggcccagacgacucgcccga

SEQ ID NO: 9036 - RNA, 51 nt, Artificial Sequence
  Description of Artificial Sequence: Synthetic oligonucleotide
gggaggacgaugcgguuugaaggguguagggaccgcagacgacucgcccga

SEQ ID NO: 9037 - RNA, 51 nt, Artificial Sequence
  Description of Artificial Sequence: Synthetic oligonucleotide
gggaggacgaugcggccguagcgucuccaucugugcagacgacucgcccga

SEQ ID NO: 9038 - RNA, 51 nt, Artificial Sequence
  Description of Artificial Sequence: Synthetic oligonucleotide
gggaggacgaugcggcuaguccguuuguaacgccacagacgacucgcccga

SEQ ID NO: 9039 - RNA, 51 nt, Artificial Sequence
  Description of Artificial Sequence: Synthetic oligonucleotide
gggaggacgaugcggugagcgcucuguuuccgccccagacgacucgcccga

SEQ ID NO: 9040 - RNA, 50 nt, Artificial Sequence
  Description of Artificial Sequence: Synthetic oligonucleotide
gggaggacgaugcggugggacucugcguguugugcagacgacucgcccga

SEQ ID NO: 9041 - RNA, 51 nt, Artificial Sequence
  Description of Artificial Sequence: Synthetic oligonucleotide
gggaggacgaugcggcuaauagguggaguaggguacagacgacucgcccga

SEQ ID NO: 9042 - RNA, 51 nt, Artificial Sequence
  Description of Artificial Sequence: Synthetic oligonucleotide
gggaggacgaugcgguuugaagggugaugggucgccagacgacucgcccga

SEQ ID NO: 9043 - RNA, 51 nt, Artificial Sequence
  Description of Artificial Sequence: Synthetic oligonucleotide
gggaggacgaugcgguacuacaagauacagugccccagacgacucgcccga

SEQ ID NO: 9044 - RNA, 51 nt, Artificial Sequence
  Description of Artificial Sequence: Synthetic oligonucleotide
gggaggacgaugcgguccagcccguugucguuggccagacgacucgcccga

SEQ ID NO: 9045 - RNA, 51 nt, Artificial Sequence
  Description of Artificial Sequence: Synthetic oligonucleotide
gggaggacgaugcggcgaucguaggucguugugcccagacgacucgcccga

SEQ ID NO: 9046 - RNA, 51 nt, Artificial Sequence
  Description of Artificial Sequence: Synthetic oligonucleotide
gggaggacgaugcggacgaagcguuuguacgggcccagacgacucgcccga

SEQ ID NO: 9047 - RNA, 52 nt, Artificial Sequence
  Description of Artificial Sequence: Synthetic oligonucleotide
gggaggacgaugcggguccugucguguguucguccccagacgacucgcccga

SEQ ID NO: 9048 - RNA, 51 nt, Artificial Sequence
  Description of Artificial Sequence: Synthetic oligonucleotide
gggaggacgaugcggauugguggagggagggaccgcagacgacucgcccga

SEQ ID NO: 9049 - RNA, 49 nt, Artificial Sequence
  Description of Artificial Sequence: Synthetic oligonucleotide
gggaggacgaugcgggccuuguucugaccuccccagacgacucgcccga

SEQ ID NO: 9050 - RNA, 51 nt, Artificial Sequence
  Description of Artificial Sequence: Synthetic oligonucleotide
gggaggacgaugcggguugucaugacguucguccccagacgacucgcccga

SEQ ID NO: 9051 - RNA, 51 nt, Artificial Sequence
  Description of Artificial Sequence: Synthetic oligonucleotide
gggaggacgaugcggucgaucuuggugucccuugccagacgacucgcccga

SEQ ID NO: 9052 - RNA, 51 nt, Artificial Sequence
  Description of Artificial Sequence: Synthetic oligonucleotide
gggaggacgaugcggaugauguguaguagccgccccagacgacucgcccga

SEQ ID NO: 9053 - RNA, 51 nt, Artificial Sequence
  Description of Artificial Sequence: Synthetic oligonucleotide
gggaggacgaugcggcaugaauguuucccgcgcaccagacgacucgcccga

SEQ ID NO: 9054 - RNA, 51 nt, Artificial Sequence
  Description of Artificial Sequence: Synthetic oligonucleotide
gggaggacgaugcggucgcuaaucuccugucugugcagacgacucgcccga

SEQ ID NO: 9055 - RNA, 51 nt, Artificial Sequence
  Description of Artificial Sequence: Synthetic oligonucleotide
gggaggacgaugcggagguccucagauugcgugcccagacgacucgcccga

SEQ ID NO: 9056 - RNA, 51 nt, Artificial Sequence
  Description of Artificial Sequence: Synthetic oligonucleotide
gggaggacgaugcggauuggagaggggagggacugcagacgacucgcccga

SEQ ID NO: 9057 - RNA, 51 nt, Artificial Sequence
  Description of Artificial Sequence: Synthetic oligonucleotide
gggaggacgaugcgguugggcguaggguggcaccgcagacgacucgcccga

SEQ ID NO: 9058 - RNA, 51 nt, Artificial Sequence
  Description of Artificial Sequence: Synthetic oligonucleotide
gggaggacgaugcggugucgucaacgcguucugugcagacgacucgcccga

SEQ ID NO: 9059 - RNA, 50 nt, Artificial Sequence
  Description of Artificial Sequence: Synthetic oligonucleotide
gggaggacgaugcggauuggugaagggugaaccgcagacgacucgcccga

SEQ ID NO: 9060 - RNA, 51 nt, Artificial Sequence
  Description of Artificial Sequence: Synthetic oligonucleotide
gggaggacgaugcgguuugaagggcgauggguccacagacgacucgcccga

SEQ ID NO: 9061 - RNA, 51 nt, Artificial Sequence
  Description of Artificial Sequence: Synthetic oligonucleotide
gggaggacgaugcggauugcgcuacucuccugugccagacgacucgcccga

SEQ ID NO: 9062 - RNA, 51 nt, Artificial Sequence
  Description of Artificial Sequence: Synthetic oligonucleotide
gggaggacgaugcggccguacuuuacagucgugcccagacgacucgcccga

SEQ ID NO: 9063 - RNA, 51 nt, Artificial Sequence
  Description of Artificial Sequence: Synthetic oligonucleotide
gggaggacgaugcgguauuggagguguaggaaccgcagacgacucgcccga

SEQ ID NO: 9064 - RNA, 51 nt, Artificial Sequence
  Description of Artificial Sequence: Synthetic oligonucleotide
gggaggacgaugcggucgucacaaacugugugccccagacgacucgcccga

SEQ ID NO: 9065 - RNA, 51 nt, Artificial Sequence
  Description of Artificial Sequence: Synthetic oligonucleotide
gggaggacgaugcgggaauucacgugucgcugggccagacgacucgcccga

SEQ ID NO: 9066 - RNA, 51 nt, Artificial Sequence
  Description of Artificial Sequence: Synthetic oligonucleotide
gggaggacgaugcggucgauugugucguucugcggcagacgacucgcccga

SEQ ID NO: 9067 - RNA, 51 nt, Artificial Sequence
  Description of Artificial Sequence: Synthetic oligonucleotide
gggaggacgaugcggaagauucugggacacuacugcagacgacucgcccga

SEQ ID NO: 9068 - RNA, 51 nt, Artificial Sequence
  Description of Artificial Sequence: Synthetic oligonucleotide
gggaggacgaugcggcauccuaucuuguuccgcaccagacgacucgcccga

SEQ ID NO: 9069 - RNA, 51 nt, Artificial Sequence
  Description of Artificial Sequence: Synthetic oligonucleotide
gggaggacgaugcggucacuugguuucgacugcgccagacgacucgcccga

SEQ ID NO: 9070 - RNA, 51 nt, Artificial Sequence
  Description of Artificial Sequence: Synthetic oligonucleotide
gggaggacgaugcggaugagugaguugugugcccccagacgacucgcccga

SEQ ID NO: 9071 - RNA, 51 nt, Artificial Sequence
  Description of Artificial Sequence: Synthetic oligonucleotide
gggaggacgaugcgggcuccaauguugucugcggccagacgacucgcccga

SEQ ID NO: 9072 - RNA, 51 nt, Artificial Sequence
  Description of Artificial Sequence: Synthetic oligonucleotide
gggaggacgaugcggugagcccauggcuuuuuggccagacgacucgcccga

SEQ ID NO: 9073 - RNA, 51 nt, Artificial Sequence
  Description of Artificial Sequence: Synthetic oligonucleotide
gggaggacgaugcgggugucaggauauaugcucugcagacgacucgcccga

SEQ ID NO: 9074 - RNA, 51 nt, Artificial Sequence
  Description of Artificial Sequence: Synthetic oligonucleotide
gggaggacgaugcgguuugaagggggauggauccgcagacgacucgcccga

SEQ ID NO: 9075 - RNA, 50 nt, Artificial Sequence
  Description of Artificial Sequence: Synthetic oligonucleotide
gggaggacgaugcgguccugucgucuguucguuccagacgacucgcccga

SEQ ID NO: 9076 - RNA, 51 nt, Artificial Sequence
  Description of Artificial Sequence: Synthetic oligonucleotide
gggaggacgaugcgguugauccuccucucguggaccagacgacucgcccga

SEQ ID NO: 9077 - RNA, 51 nt, Artificial Sequence
  Description of Artificial Sequence: Synthetic oligonucleotide
gggaggacgaugcgguuugaaggaagauggguccgcagacgacucgcccga

SEQ ID NO: 9078 - RNA, 51 nt, Artificial Sequence
  Description of Artificial Sequence: Synthetic oligonucleotide
gggaggacgaugcgguuugaagggugguugguccgcagacgacucgcccga

SEQ ID NO: 9079 - RNA, 51 nt, Artificial Sequence
  Description of Artificial Sequence: Synthetic oligonucleotide
gggaggacgaugcgguuuuaagggcgauggguccgcagacgacucgcccga

SEQ ID NO: 9080 - RNA, 51 nt, Artificial Sequence
  Description of Artificial Sequence: Synthetic oligonucleotide
gggaggacgaugcggaaucguagccuccaugugcccagacgacucgcccga

SEQ ID NO: 9081 - RNA, 51 nt, Artificial Sequence
  Description of Artificial Sequence: Synthetic oligonucleotide
gggaggacgaugcgguuugaagggagaugggucugcagacgacucgcccga

SEQ ID NO: 9082 - RNA, 51 nt, Artificial Sequence
  Description of Artificial Sequence: Synthetic oligonucleotide
gggaggacgaugcggauccguaagucacccgugugcagacgacucgcccga

SEQ ID NO: 9083 - RNA, 51 nt, Artificial Sequence
  Description of Artificial Sequence: Synthetic oligonucleotide
gggaggacgaugcggguuuugguugugugccgcugcagacgacucgcccga

SEQ ID NO: 9084 - RNA, 51 nt, Artificial Sequence
  Description of Artificial Sequence: Synthetic oligonucleotide
gggaggacgaugcgguuugaaggggggugggacugcagacgacucgcccga

SEQ ID NO: 9085 - RNA, 51 nt, Artificial Sequence
  Description of Artificial Sequence: Synthetic oligonucleotide
gggaggacgaugcgguuugaaggacgauggguccgcagacgacucgcccga

SEQ ID NO: 9086 - RNA, 51 nt, Artificial Sequence
  Description of Artificial Sequence: Synthetic oligonucleotide
gggaggacgaugcgguguagggaggugguuaucgucagacgacucgcccga

SEQ ID NO: 9087 - RNA, 49 nt, Artificial Sequence
  Description of Artificial Sequence: Synthetic oligonucleotide
gggaggacgaugcgguuggguguagggguaccgcagacgacucgcccga

SEQ ID NO: 9088 - RNA, 49 nt, Artificial Sequence
  Description of Artificial Sequence: Synthetic oligonucleotide
gggaggacgaugcgguuaagggugauggguccgcagacgacucgcccga

SEQ ID NO: 9089 - RNA, 51 nt, Artificial Sequence
  Description of Artificial Sequence: Synthetic oligonucleotide
gggaggacgaugcgguuuggaggggggugguaccgcagacgacucgcccga

SEQ ID NO: 9090 - RNA, 51 nt, Artificial Sequence
  Description of Artificial Sequence: Synthetic oligonucleotide
gggaggacgaugcgguauuggagguguagagaccgcagacgacucgcccga

SEQ ID NO: 9091 - RNA, 51 nt, Artificial Sequence
  Description of Artificial Sequence: Synthetic oligonucleotide
gggaggacgaugcggugagugucucccuuggucugcagacgacucgcccga

SEQ ID NO: 9092 - RNA, 51 nt, Artificial Sequence
  Description of Artificial Sequence: Synthetic oligonucleotide
gggaggacgaugcggguugaguagaucuggugccgcagacgacucgcccga

SEQ ID NO: 9093 - RNA, 51 nt, Artificial Sequence
  Description of Artificial Sequence: Synthetic oligonucleotide
gggaggacgaugcggguaugaagucgccgcgucugcagacgacucgcccga

SEQ ID NO: 9094 - RNA, 51 nt, Artificial Sequence
  Description of Artificial Sequence: Synthetic oligonucleotide
gggaggacgaugcgggccauaaucuucugcugccgcagacgacucgcccga

SEQ ID NO: 9095 - RNA, 51 nt, Artificial Sequence
  Description of Artificial Sequence: Synthetic oligonucleotide
gggaggacgaugcgggucuucuggccuaucguccccagacgacucgcccga

SEQ ID NO: 9096 - RNA, 51 nt, Artificial Sequence
  Description of Artificial Sequence: Synthetic oligonucleotide
gggaggacgaugcggacuaugucgucuuguccccacagacgacucgcccga

SEQ ID NO: 9097 - RNA, 51 nt, Artificial Sequence
  Description of Artificial Sequence: Synthetic oligonucleotide
gggaggacgaugcgguagacuccguucccugucgccagacgacucgcccga

SEQ ID NO: 9098 - RNA, 51 nt, Artificial Sequence
  Description of Artificial Sequence: Synthetic oligonucleotide
gggaggacgaugcggcgauucgaucuguucguccccagacgacucgcccga

SEQ ID NO: 9099 - RNA, 51 nt, Artificial Sequence
  Description of Artificial Sequence: Synthetic oligonucleotide
gggaggacgaugcggagugaaguuuggaguugcgccagacgacucgcccga

SEQ ID NO: 9100 - RNA, 51 nt, Artificial Sequence
  Description of Artificial Sequence: Synthetic oligonucleotide
gggaggacgaugcgggaagucuguuuuugccgcgccagacgacucgcccga

SEQ ID NO: 9101 - RNA, 51 nt, Artificial Sequence
  Description of Artificial Sequence: Synthetic oligonucleotide
gggaggacgaugcggcaucuagacucccgcgugugcagacgacucgcccga

SEQ ID NO: 9102 - RNA, 51 nt, Artificial Sequence
  Description of Artificial Sequence: Synthetic oligonucleotide
gggaggacgaugcgguugucugcgauggcgguggccagacgacucgcccga

SEQ ID NO: 9103 - RNA, 51 nt, Artificial Sequence
  Description of Artificial Sequence: Synthetic oligonucleotide
gggaggacgaugcggggcuuucguucugaccuccccagacgacucgcccga

SEQ ID NO: 9104 - RNA, 51 nt, Artificial Sequence
  Description of Artificial Sequence: Synthetic oligonucleotide
gggaggacgaugcgguauuuggugaaguggaggugcagacgacucgcccga

SEQ ID NO: 9105 - RNA, 51 nt, Artificial Sequence
  Description of Artificial Sequence: Synthetic oligonucleotide
gggaggacgaugcggcccauaaccaaugugugccccagacgacucgcccga

SEQ ID NO: 9106 - RNA, 51 nt, Artificial Sequence
  Description of Artificial Sequence: Synthetic oligonucleotide
gggaggacgaugcggugugguguaacuggugaccccagacgacucgcccga

SEQ ID NO: 9107 - RNA, 51 nt, Artificial Sequence
  Description of Artificial Sequence: Synthetic oligonucleotide
gggaggacgaugcggauugacgucgcugcgcacugcagacgacucgcccga

SEQ ID NO: 9108 - RNA, 51 nt, Artificial Sequence
  Description of Artificial Sequence: Synthetic oligonucleotide
gggaggacgaugcggcacccuaagaccucaauccgcagacgacucgcccga

SEQ ID NO: 9109 - RNA, 51 nt, Artificial Sequence
  Description of Artificial Sequence: Synthetic oligonucleotide
gggaggacgaugcggcuaguucucucgucggucugcagacgacucgcccga

SEQ ID NO: 9110 - RNA, 51 nt, Artificial Sequence
  Description of Artificial Sequence: Synthetic oligonucleotide
gggaggacgaugcggauuggggaagggagggacugcagacgacucgcccga

SEQ ID NO: 9111 - RNA, 51 nt, Artificial Sequence
  Description of Artificial Sequence: Synthetic oligonucleotide
gggaggacgaugcggguuccucgucucugcauguccagacgacucgcccga

SEQ ID NO: 9112 - RNA, 51 nt, Artificial Sequence
  Description of Artificial Sequence: Synthetic oligonucleotide
gggaggacgaugcgguuugaggggugauggguccccagacgacucgcccga

SEQ ID NO: 9113 - RNA, 51 nt, Artificial Sequence
  Description of Artificial Sequence: Synthetic oligonucleotide
gggaggacgaugcggaguucuggacaugccgcgaccagacgacucgcccga

SEQ ID NO: 9114 - RNA, 51 nt, Artificial Sequence
  Description of Artificial Sequence: Synthetic oligonucleotide
gggaggacgaugcgguacugguucccacuugucugcagacgacucgcccga

SEQ ID NO: 9115 - RNA, 51 nt, Artificial Sequence
  Description of Artificial Sequence: Synthetic oligonucleotide
gggaggacgaugcggugugucuugucugcuugcugcagacgacucgcccga

SEQ ID NO: 9116 - RNA, 51 nt, Artificial Sequence
  Description of Artificial Sequence: Synthetic oligonucleotide
gggaggacgaugcggccguugucuagguguaugcccagacgacucgcccga

SEQ ID NO: 9117 - RNA, 51 nt, Artificial Sequence
  Description of Artificial Sequence: Synthetic oligonucleotide
gggaggacgaugcggaaaucgaccuuccacguggccagacgacucgcccga

SEQ ID NO: 9118 - RNA, 51 nt, Artificial Sequence
  Description of Artificial Sequence: Synthetic oligonucleotide
gggaggacgaugcgguaaagucgucaacacagcgccagacgacucgcccga

SEQ ID NO: 9119 - RNA, 51 nt, Artificial Sequence
  Description of Artificial Sequence: Synthetic oligonucleotide
gggaggacgaugcgguucauccuucgacgucugugcagacgacucgcccga

SEQ ID NO: 9120 - RNA, 51 nt, Artificial Sequence
  Description of Artificial Sequence: Synthetic oligonucleotide
gggaggacgaugcggauuaggaguguagucgugcccagacgacucgcccga

SEQ ID NO: 9121 - RNA, 50 nt, Artificial Sequence
  Description of Artificial Sequence: Synthetic oligonucleotide
gggaggacgaugcggcugucgucuuguucguccccagacgacucgcccga

SEQ ID NO: 9122 - RNA, 51 nt, Artificial Sequence
  Description of Artificial Sequence: Synthetic oligonucleotide
gggaggacgaugcgguuugaagggggaugggucagcagacgacucgcccga

SEQ ID NO: 9123 - RNA, 51 nt, Artificial Sequence
  Description of Artificial Sequence: Synthetic oligonucleotide
gggaggacgaugcggaaccaagccucucugcgugccagacgacucgcccga

SEQ ID NO: 9124 - RNA, 51 nt, Artificial Sequence
  Description of Artificial Sequence: Synthetic oligonucleotide
gggaggacgaugcggcuugucgucuuguuuguccccagacgacucgcccga

SEQ ID NO: 9125 - RNA, 51 nt, Artificial Sequence
  Description of Artificial Sequence: Synthetic oligonucleotide
gggaggacgaugcgguugggugaagggugguacugcagacgacucgcccga

SEQ ID NO: 9126 - RNA, 51 nt, Artificial Sequence
  Description of Artificial Sequence: Synthetic oligonucleotide
gggaggacgaugcgggagucauguacacgauugugcagacgacucgcccga

SEQ ID NO: 9127 - RNA, 51 nt, Artificial Sequence
  Description of Artificial Sequence: Synthetic oligonucleotide
gggaggacgaugcgguacgauaggcucaugcgcugcagacgacucgcccga

SEQ ID NO: 9128 - RNA, 51 nt, Artificial Sequence
  Description of Artificial Sequence: Synthetic oligonucleotide
gggaggacgaugcggacugagaauaaugguggccgcagacgacucgcccga

SEQ ID NO: 9129 - RNA, 51 nt, Artificial Sequence
  Description of Artificial Sequence: Synthetic oligonucleotide
gggaggacgaugcggaccuccacacuaucgugccccagacgacucgcccga

SEQ ID NO: 9130 - RNA, 50 nt, Artificial Sequence
  Description of Artificial Sequence: Synthetic oligonucleotide
gggaggacgaugcggcuauuggugaaggggggugcagacgacucgcccga

SEQ ID NO: 9131 - RNA, 51 nt, Artificial Sequence
  Description of Artificial Sequence: Synthetic oligonucleotide
gggaggacgaugcgguccucuucuguagucugugccagacgacucgcccga

SEQ ID NO: 9132 - RNA, 49 nt, Artificial Sequence
  Description of Artificial Sequence: Synthetic oligonucleotide
gggaggacgaugcgguuuuuggugauggguccgcagacgacucgcccga

SEQ ID NO: 9133 - RNA, 51 nt, Artificial Sequence
  Description of Artificial Sequence: Synthetic oligonucleotide
gggaggacgaugcggugagacguucgguacaucgccagacgacucgcccga

SEQ ID NO: 9134 - RNA, 51 nt, Artificial Sequence
  Description of Artificial Sequence: Synthetic oligonucleotide
gggaggacgaugcggcauuggaaucccacucuccccagacgacucgcccga

SEQ ID NO: 9135 - RNA, 51 nt, Artificial Sequence
  Description of Artificial Sequence: Synthetic oligonucleotide
gggaggacgaugcggaauucgucaaugcgcugccccagacgacucgcccga

SEQ ID NO: 9136 - RNA, 51 nt, Artificial Sequence
  Description of Artificial Sequence: Synthetic oligonucleotide
gggaggacgaugcggagugagccucuucgaugccgcagacgacucgcccga

SEQ ID NO: 9137 - RNA, 51 nt, Artificial Sequence
  Description of Artificial Sequence: Synthetic oligonucleotide
gggaggacgaugcgguuagggcauuccuuccugcccagacgacucgcccga

SEQ ID NO: 9138 - RNA, 51 nt, Artificial Sequence
  Description of Artificial Sequence: Synthetic oligonucleotide
gggaggacgaugcgggcaggagaguuuagcggcgccagacgacucgcccga

SEQ ID NO: 9139 - RNA, 51 nt, Artificial Sequence
  Description of Artificial Sequence: Synthetic oligonucleotide
gggaggacgaugcgguauccuaguccccucgucugcagacgacucgcccga

SEQ ID NO: 9140 - RNA, 51 nt, Artificial Sequence
  Description of Artificial Sequence: Synthetic oligonucleotide
gggaggacgaugcggacauggccuugcacguuguccagacgacucgcccga

SEQ ID NO: 9141 - RNA, 50 nt, Artificial Sequence
  Description of Artificial Sequence: Synthetic oligonucleotide
gggaggacgaugcggggagaaacccugugguguacagacgacucgcccga

SEQ ID NO: 9142 - RNA, 51 nt, Artificial Sequence
  Description of Artificial Sequence: Synthetic oligonucleotide
gggaggacgaugcggcuugucuccggucugcuggccagacgacucgcccga

SEQ ID NO: 9143 - RNA, 51 nt, Artificial Sequence
  Description of Artificial Sequence: Synthetic oligonucleotide
gggaggacgaugcgguagugucugguauugcacaccagacgacucgcccga

SEQ ID NO: 9144 - RNA, 51 nt, Artificial Sequence
  Description of Artificial Sequence: Synthetic oligonucleotide
gggaggacgaugcggacagucggauugggccaccacagacgacucgcccga

SEQ ID NO: 9145 - RNA, 52 nt, Artificial Sequence
  Description of Artificial Sequence: Synthetic oligonucleotide
gggaggacgaugcggauuggugaagggagguuacugcagacgacucgcccga

SEQ ID NO: 9146 - RNA, 51 nt, Artificial Sequence
  Description of Artificial Sequence: Synthetic oligonucleotide
gggaggacgaugcgguuggguguagggagggaccgcagacgacucgcccga

SEQ ID NO: 9147 - RNA, 51 nt, Artificial Sequence
  Description of Artificial Sequence: Synthetic oligonucleotide
gggaggacgaugcgggugucugagugugccuuccccagacgacucgcccga

SEQ ID NO: 9148 - RNA, 50 nt, Artificial Sequence
  Description of Artificial Sequence: Synthetic oligonucleotide
gggaggacgaugcgguuugaaggugguggguccgcagacgacucgcccga

SEQ ID NO: 9149 - RNA, 51 nt, Artificial Sequence
  Description of Artificial Sequence: Synthetic oligonucleotide
gggaggacgaugcggaucguucucucucccgugcccagacgacucgcccga

SEQ ID NO: 9150 - RNA, 51 nt, Artificial Sequence
  Description of Artificial Sequence: Synthetic oligonucleotide
gggaggacgaugcggaggaauacagucaaggucugcagacgacucgcccga

SEQ ID NO: 9151 - RNA, 51 nt, Artificial Sequence
  Description of Artificial Sequence: Synthetic oligonucleotide
gggaggacgaugcgguccaaacgagcucugcugcccagacgacucgcccga

SEQ ID NO: 9152 - RNA, 51 nt, Artificial Sequence
  Description of Artificial Sequence: Synthetic oligonucleotide
gggaggacgaugcggaugaaggcccguacacccugcagacgacucgcccga

SEQ ID NO: 9153 - RNA, 51 nt, Artificial Sequence
  Description of Artificial Sequence: Synthetic oligonucleotide
gggaggacgaugcgguguccuuucuccgucugccgcagacgacucgcccga

SEQ ID NO: 9154 - RNA, 51 nt, Artificial Sequence
  Description of Artificial Sequence: Synthetic oligonucleotide
gggaggacgaugcggguccaccaugauguugucugcagacgacucgcccga

SEQ ID NO: 9155 - RNA, 51 nt, Artificial Sequence
  Description of Artificial Sequence: Synthetic oligonucleotide
gggaggacgaugcgguuccucgaucaccgauacugcagacgacucgcccga

SEQ ID NO: 9156 - RNA, 51 nt, Artificial Sequence
  Description of Artificial Sequence: Synthetic oligonucleotide
gggaggacgaugcggaccauguuuuaagugugcgccagacgacucgcccga

SEQ ID NO: 9157 - RNA, 51 nt, Artificial Sequence
  Description of Artificial Sequence: Synthetic oligonucleotide
gggaggacgaugcgguagugugagucgcccuugugcagacgacucgcccga

SEQ ID NO: 9158 - RNA, 51 nt, Artificial Sequence
  Description of Artificial Sequence: Synthetic oligonucleotide
gggaggacgaugcgguccauugcuucucgucuggccagacgacucgcccga

SEQ ID NO: 9159 - RNA, 51 nt, Artificial Sequence
  Description of Artificial Sequence: Synthetic oligonucleotide
gggaggacgaugcggugauacaaauuuuacugcugcagacgacucgcccga

SEQ ID NO: 9160 - RNA, 51 nt, Artificial Sequence
  Description of Artificial Sequence: Synthetic oligonucleotide
gggaggacgaugcgguuuguacaacggucuggcgccagacgacucgcccga

SEQ ID NO: 9161 - RNA, 51 nt, Artificial Sequence
  Description of Artificial Sequence: Synthetic oligonucleotide
gggaggacgaugcgguaccacauauagacugggcccagacgacucgcccga

SEQ ID NO: 9162 - RNA, 51 nt, Artificial Sequence
  Description of Artificial Sequence: Synthetic oligonucleotide
gggaggacgaugcggauugcccauauccuccugcccagacgacucgcccga

SEQ ID NO: 9163 - RNA, 51 nt, Artificial Sequence
  Description of Artificial Sequence: Synthetic oligonucleotide
gggaggacgaugcggaucguuugugcuaugguggccagacgacucgcccga

SEQ ID NO: 9164 - RNA, 51 nt, Artificial Sequence
  Description of Artificial Sequence: Synthetic oligonucleotide
gggaggacgaugcgggccuuuucgucuugccuccccagacgacucgcccga

SEQ ID NO: 9165 - RNA, 51 nt, Artificial Sequence
  Description of Artificial Sequence: Synthetic oligonucleotide
gggaggacgaugcggauuggcgaagggaggcacugcagacgacucgcccga

SEQ ID NO: 9166 - RNA, 50 nt, Artificial Sequence
  Description of Artificial Sequence: Synthetic oligonucleotide
gggaggacgaugcgguguaggaggaggaguaccgcagacgacucgcccga

SEQ ID NO: 9167 - RNA, 51 nt, Artificial Sequence
  Description of Artificial Sequence: Synthetic oligonucleotide
gggaggacgaugcgguuccucuauccucguguccccagacgacucgcccga

SEQ ID NO: 9168 - RNA, 51 nt, Artificial Sequence
  Description of Artificial Sequence: Synthetic oligonucleotide
gggaggacgaugcggauagggagaggggugaaccgcagacgacucgcccga

SEQ ID NO: 9169 - RNA, 51 nt, Artificial Sequence
  Description of Artificial Sequence: Synthetic oligonucleotide
gggaggacgaugcggcgaauaggucucgccauggccagacgacucgcccga

SEQ ID NO: 9170 - RNA, 51 nt, Artificial Sequence
  Description of Artificial Sequence: Synthetic oligonucleotide
gggaggacgaugcggugacucgucuguuucguucccagacgacucgcccga

SEQ ID NO: 9171 - RNA, 51 nt, Artificial Sequence
  Description of Artificial Sequence: Synthetic oligonucleotide
gggaggacgaugcgguccacuguucccaaccuccccagacgacucgcccga

SEQ ID NO: 9172 - RNA, 51 nt, Artificial Sequence
  Description of Artificial Sequence: Synthetic oligonucleotide
gggaggacgaugcgguuugguggggggugggaccgcagacgacucgcccga

SEQ ID NO: 9173 - RNA, 50 nt, Artificial Sequence
  Description of Artificial Sequence: Synthetic oligonucleotide
gggaggacgaugcgggccuuucguucugcccacccagacgacucgcccga

SEQ ID NO: 9174 - RNA, 51 nt, Artificial Sequence
  Description of Artificial Sequence: Synthetic oligonucleotide
gggaggacgaugcggaccgacgaacaauguggccccagacgacucgcccga

SEQ ID NO: 9175 - RNA, 51 nt, Artificial Sequence
  Description of Artificial Sequence: Synthetic oligonucleotide
gggaggacgaugcggcaccguuagcguuugcuggccagacgacucgcccga

SEQ ID NO: 9176 - RNA, 51 nt, Artificial Sequence
  Description of Artificial Sequence: Synthetic oligonucleotide
gggaggacgaugcgguuggaaguagggugggaccgcagacgacucgcccga

SEQ ID NO: 9177 - RNA, 51 nt, Artificial Sequence
  Description of Artificial Sequence: Synthetic oligonucleotide
gggaggacgaugcgguguccauaucguaaccuccccagacgacucgcccga

SEQ ID NO: 9178 - RNA, 51 nt, Artificial Sequence
  Description of Artificial Sequence: Synthetic oligonucleotide
gggaggacgaugcgguuugaaggggggugguaccgcagacgacucgcccga

SEQ ID NO: 9179 - RNA, 51 nt, Artificial Sequence
  Description of Artificial Sequence: Synthetic oligonucleotide
gggaggacgaugcggucggacuagucguuuugcgccagacgacucgcccga

SEQ ID NO: 9180 - RNA, 51 nt, Artificial Sequence
  Description of Artificial Sequence: Synthetic oligonucleotide
gggaggacgaugcgguccuuucguucugagcuccccagacgacucgcccga

SEQ ID NO: 9181 - RNA, 51 nt, Artificial Sequence
  Description of Artificial Sequence: Synthetic oligonucleotide
gggaggacgaugcgguuugacgggugcuggguccgcagacgacucgcccga

SEQ ID NO: 9182 - RNA, 51 nt, Artificial Sequence
  Description of Artificial Sequence: Synthetic oligonucleotide
gggaggacgaugcggauuggugacgggagguaccgcagacgacucgcccga

SEQ ID NO: 9183 - RNA, 51 nt, Artificial Sequence
  Description of Artificial Sequence: Synthetic oligonucleotide
gggaggacgaugcgguuugaagggagauggguccacagacgacucgcccga

SEQ ID NO: 9184 - RNA, 51 nt, Artificial Sequence
  Description of Artificial Sequence: Synthetic oligonucleotide
gggaggacgaugcgguuugaagggagauagguccgcagacgacucgcccga

SEQ ID NO: 9185 - RNA, 52 nt, Artificial Sequence
  Description of Artificial Sequence: Synthetic oligonucleotide
gggaggacgaugcgggccuuucguuucugcccuccccagacgacucgcccga

SEQ ID NO: 9186 - RNA, 51 nt, Artificial Sequence
  Description of Artificial Sequence: Synthetic oligonucleotide
gggaggacgaugcggguugaugucuugggcugcugcagacgacucgcccga

SEQ ID NO: 9187 - RNA, 52 nt, Artificial Sequence
  Description of Artificial Sequence: Synthetic oligonucleotide
gggaggacgaugcgggccuuucguucugccuucccccagacgacucgcccga

SEQ ID NO: 9188 - RNA, 51 nt, Artificial Sequence
  Description of Artificial Sequence: Synthetic oligonucleotide
gggaggacgaugcgguuggguguagggcgggaccgcagacgacucgcccga

SEQ ID NO: 9189 - RNA, 51 nt, Artificial Sequence
  Description of Artificial Sequence: Synthetic oligonucleotide
gggaggacgaugcggguugaagggugaugggcccgcagacgacucgcccga

SEQ ID NO: 9190 - RNA, 51 nt, Artificial Sequence
  Description of Artificial Sequence: Synthetic oligonucleotide
gggaggacgaugcgguuugaagggggauugguccgcagacgacucgcccga

SEQ ID NO: 9191 - RNA, 50 nt, Artificial Sequence
  Description of Artificial Sequence: Synthetic oligonucleotide
gggaggacgaugcggauuggugaagggaggucugcagacgacucgcccga

SEQ ID NO: 9192 - RNA, 51 nt, Artificial Sequence
  Description of Artificial Sequence: Synthetic oligonucleotide
gggaggacgaugcgguuugcagggugaugggcccgcagacgacucgcccga

SEQ ID NO: 9193 - RNA, 51 nt, Artificial Sequence
  Description of Artificial Sequence: Synthetic oligonucleotide
gggaggacgaugcggauuggagaagggugggaccgcagacgacucgcccga

SEQ ID NO: 9194 - RNA, 51 nt, Artificial Sequence
  Description of Artificial Sequence: Synthetic oligonucleotide
gggaggacgaugcgguuugaagggagauugguccgcagacgacucgcccga

SEQ ID NO: 9195 - RNA, 51 nt, Artificial Sequence
  Description of Artificial Sequence: Synthetic oligonucleotide
gggaggacgaugcggcuugucgucuuguucguucccagacgacucgcccga

SEQ ID NO: 9196 - RNA, 51 nt, Artificial Sequence
  Description of Artificial Sequence: Synthetic oligonucleotide
gggaggacgaugcggugggucgucuucuguucccccagacgacucgcccga

SEQ ID NO: 9197 - RNA, 51 nt, Artificial Sequence
  Description of Artificial Sequence: Synthetic oligonucleotide
gggaggacgaugcgguuggcauaucacacgguguccagacgacucgcccga

SEQ ID NO: 9198 - RNA, 51 nt, Artificial Sequence
  Description of Artificial Sequence: Synthetic oligonucleotide
gggaggacgaugcgguuggucgucugaaaccuccccagacgacucgcccga

SEQ ID NO: 9199 - RNA, 51 nt, Artificial Sequence
  Description of Artificial Sequence: Synthetic oligonucleotide
gggaggacgaugcgguggaucguuuggugacacgccagacgacucgcccga

SEQ ID NO: 9200 - RNA, 51 nt, Artificial Sequence
  Description of Artificial Sequence: Synthetic oligonucleotide
gggaggacgaugcggagucccaacuguuguugcugcagacgacucgcccga

SEQ ID NO: 9201 - RNA, 51 nt, Artificial Sequence
  Description of Artificial Sequence: Synthetic oligonucleotide
gggaggacgaugcggaaaagggucuucgucugcgccagacgacucgcccga

SEQ ID NO: 9202 - RNA, 51 nt, Artificial Sequence
  Description of Artificial Sequence: Synthetic oligonucleotide
gggaggacgaugcggccgagucuuccugcgugcgccagacgacucgcccga

SEQ ID NO: 9203 - RNA, 51 nt, Artificial Sequence
  Description of Artificial Sequence: Synthetic oligonucleotide
gggaggacgaugcggaaaccguagccgcacgugggcagacgacucgcccga

SEQ ID NO: 9204 - RNA, 51 nt, Artificial Sequence
  Description of Artificial Sequence: Synthetic oligonucleotide
gggaggacgaugcgguggaauguuaccucuagcugcagacgacucgcccga

SEQ ID NO: 9205 - RNA, 51 nt, Artificial Sequence
  Description of Artificial Sequence: Synthetic oligonucleotide
gggaggacgaugcggccugucgcacugcgguacugcagacgacucgcccga

SEQ ID NO: 9206 - RNA, 51 nt, Artificial Sequence
  Description of Artificial Sequence: Synthetic oligonucleotide
gggaggacgaugcgguguccccgagucuguguggccagacgacucgcccga

SEQ ID NO: 9207 - RNA, 51 nt, Artificial Sequence
  Description of Artificial Sequence: Synthetic oligonucleotide
gggaggacgaugcggugcgaugcguccgaucucgccagacgacucgcccga

SEQ ID NO: 9208 - RNA, 51 nt, Artificial Sequence
  Description of Artificial Sequence: Synthetic oligonucleotide
gggaggacgaugcggguucuuggcgucuuauacugcagacgacucgcccga

SEQ ID NO: 9209 - RNA, 51 nt, Artificial Sequence
  Description of Artificial Sequence: Synthetic oligonucleotide
gggaggacgaugcggcccgcuguauuccucguccccagacgacucgcccga

SEQ ID NO: 9210 - RNA, 50 nt, Artificial Sequence
  Description of Artificial Sequence: Synthetic oligonucleotide
gggaggacgaugcggcuugucgucuuguucgucccagacgacucgcccga

SEQ ID NO: 9211 - RNA, 51 nt, Artificial Sequence
  Description of Artificial Sequence: Synthetic oligonucleotide
gggaggacgaugcgggaauccgugugauauggcugcagacgacucgcccga

SEQ ID NO: 9212 - RNA, 51 nt, Artificial Sequence
  Description of Artificial Sequence: Synthetic oligonucleotide
gggaggacgaugcgguccguaaauguuguugucgccagacgacucgcccga

SEQ ID NO: 9213 - RNA, 51 nt, Artificial Sequence
  Description of Artificial Sequence: Synthetic oligonucleotide
gggaggacgaugcggauagucuacacaugacugcccagacgacucgcccga

SEQ ID NO: 9214 - RNA, 51 nt, Artificial Sequence
  Description of Artificial Sequence: Synthetic oligonucleotide
gggaggacgaugcggaccuacgucuuuuccgugugcagacgacucgcccga

SEQ ID NO: 9215 - RNA, 51 nt, Artificial Sequence
  Description of Artificial Sequence: Synthetic oligonucleotide
gggaggacgaugcggucccaugccuuccuguaccgcagacgacucgcccga

SEQ ID NO: 9216 - RNA, 50 nt, Artificial Sequence
  Description of Artificial Sequence: Synthetic oligonucleotide
gggaggacgaugcggucaccaaacucgugcgccccagacgacucgcccga

SEQ ID NO: 9217 - RNA, 51 nt, Artificial Sequence
  Description of Artificial Sequence: Synthetic oligonucleotide
gggaggacgaugcggcaucuaccuuccuacguguccagacgacucgcccga

SEQ ID NO: 9218 - RNA, 51 nt, Artificial Sequence
  Description of Artificial Sequence: Synthetic oligonucleotide
gggaggacgaugcgguguuguugugugcgguugugcagacgacucgcccga

SEQ ID NO: 9219 - RNA, 51 nt, Artificial Sequence
  Description of Artificial Sequence: Synthetic oligonucleotide
gggaggacgaugcgggcgucugaauucucgcuccccagacgacucgcccga

SEQ ID NO: 9220 - RNA, 51 nt, Artificial Sequence
  Description of Artificial Sequence: Synthetic oligonucleotide
gggaggacgaugcgguaucguaacucaugcgugcccagacgacucgcccga

SEQ ID NO: 9221 - RNA, 51 nt, Artificial Sequence
  Description of Artificial Sequence: Synthetic oligonucleotide
gggaggacgaugcggagugucucuggguuucacgccagacgacucgcccga

SEQ ID NO: 9222 - RNA, 51 nt, Artificial Sequence
  Description of Artificial Sequence: Synthetic oligonucleotide
gggaggacgaugcggaauugugcuccucccauggccagacgacucgcccga

SEQ ID NO: 9223 - RNA, 51 nt, Artificial Sequence
  Description of Artificial Sequence: Synthetic oligonucleotide
gggaggacgaugcgguucccgauccuucccaugugcagacgacucgcccga

SEQ ID NO: 9224 - RNA, 51 nt, Artificial Sequence
  Description of Artificial Sequence: Synthetic oligonucleotide
gggaggacgaugcggguugagugugucaugccccccagacgacucgcccga

SEQ ID NO: 9225 - RNA, 51 nt, Artificial Sequence
  Description of Artificial Sequence: Synthetic oligonucleotide
gggaggacgaugcgggaccuuaguuggacacugugcagacgacucgcccga

SEQ ID NO: 9226 - RNA, 51 nt, Artificial Sequence
  Description of Artificial Sequence: Synthetic oligonucleotide
gggaggacgaugcggguacgguugguuugcugcgccagacgacucgcccga

SEQ ID NO: 9227 - RNA, 51 nt, Artificial Sequence
  Description of Artificial Sequence: Synthetic oligonucleotide
gggaggacgaugcggucacugccacuagcaauccgcagacgacucgcccga

SEQ ID NO: 9228 - RNA, 51 nt, Artificial Sequence
  Description of Artificial Sequence: Synthetic oligonucleotide
gggaggacgaugcggcagucgucauguaccgcguccagacgacucgcccga

SEQ ID NO: 9229 - RNA, 51 nt, Artificial Sequence
  Description of Artificial Sequence: Synthetic oligonucleotide
gggaggacgaugcgguccacgaauagugcacugcccagacgacucgcccga

SEQ ID NO: 9230 - RNA, 50 nt, Artificial Sequence
  Description of Artificial Sequence: Synthetic oligonucleotide
gggaggacgaugcgguuugcgauuucucccuggccagacgacucgcccga

SEQ ID NO: 9231 - RNA, 51 nt, Artificial Sequence
  Description of Artificial Sequence: Synthetic oligonucleotide
gggaggacgaugcgggaacauggcgugccucugugcagacgacucgcccga

SEQ ID NO: 9232 - RNA, 51 nt, Artificial Sequence
  Description of Artificial Sequence: Synthetic oligonucleotide
gggaggacgaugcggcccgcaauagucccagugcccagacgacucgcccga

SEQ ID NO: 9233 - RNA, 50 nt, Artificial Sequence
  Description of Artificial Sequence: Synthetic oligonucleotide
gggaggacgaugcggauuggaggugauggguccgcagacgacucgcccga

SEQ ID NO: 9234 - RNA, 51 nt, Artificial Sequence
  Description of Artificial Sequence: Synthetic oligonucleotide
gggaggacgaugcggcuugucggcuuguucguccccagacgacucgcccga

SEQ ID NO: 9235 - RNA, 51 nt, Artificial Sequence
  Description of Artificial Sequence: Synthetic oligonucleotide
gggaggacgaugcggcaucgcguaucccacgucugcagacgacucgcccga

SEQ ID NO: 9236 - RNA, 51 nt, Artificial Sequence
  Description of Artificial Sequence: Synthetic oligonucleotide
gggaggacgaugcgggccauguuagucauggggggcagacgacucgcccga

SEQ ID NO: 9237 - RNA, 51 nt, Artificial Sequence
  Description of Artificial Sequence: Synthetic oligonucleotide
gggaggacgaugcgguuugaagggugauggggucgcagacgacucgcccga

SEQ ID NO: 9238 - RNA, 51 nt, Artificial Sequence
  Description of Artificial Sequence: Synthetic oligonucleotide
gggaggacgaugcggcauguggguuaggccgucugcagacgacucgcccga

SEQ ID NO: 9239 - RNA, 51 nt, Artificial Sequence
  Description of Artificial Sequence: Synthetic oligonucleotide
gggaggacgaugcggucguguaaguguguugugugcagacgacucgcccga

SEQ ID NO: 9240 - RNA, 51 nt, Artificial Sequence
  Description of Artificial Sequence: Synthetic oligonucleotide
gggaggacgaugcgguaccaagcacguucguuggccagacgacucgcccga

SEQ ID NO: 9241 - RNA, 51 nt, Artificial Sequence
  Description of Artificial Sequence: Synthetic oligonucleotide
gggaggacgaugcggucagauguaccauuggugugcagacgacucgcccga

SEQ ID NO: 9242 - RNA, 51 nt, Artificial Sequence
  Description of Artificial Sequence: Synthetic oligonucleotide
gggaggacgaugcggugaugugaugguuggugcugcagacgacucgcccga

SEQ ID NO: 9243 - RNA, 51 nt, Artificial Sequence
  Description of Artificial Sequence: Synthetic oligonucleotide
gggaggacgaugcgggguuugagcguccuugugugcagacgacucgcccga

SEQ ID NO: 9244 - RNA, 51 nt, Artificial Sequence
  Description of Artificial Sequence: Synthetic oligonucleotide
gggaggacgaugcgguguuugcuaauaacgcugugcagacgacucgcccga

SEQ ID NO: 9245 - RNA, 51 nt, Artificial Sequence
  Description of Artificial Sequence: Synthetic oligonucleotide
gggaggacgaugcggaggcuugucugccguuggugcagacgacucgcccga

SEQ ID NO: 9246 - RNA, 51 nt, Artificial Sequence
  Description of Artificial Sequence: Synthetic oligonucleotide
gggaggacgaugcggaauuugguggaaacgcgcugcagacgacucgcccga

SEQ ID NO: 9247 - RNA, 51 nt, Artificial Sequence
  Description of Artificial Sequence: Synthetic oligonucleotide
gggaggacgaugcgguuuggagggugauggguccccagacgacucgcccga

SEQ ID NO: 9248 - RNA, 51 nt, Artificial Sequence
  Description of Artificial Sequence: Synthetic oligonucleotide
gggaggacgaugcgguguagucuuaacccgauggccagacgacucgcccga

SEQ ID NO: 9249 - RNA, 51 nt, Artificial Sequence
  Description of Artificial Sequence: Synthetic oligonucleotide
gggaggacgaugcggugaguugucccaaucugcugcagacgacucgcccga

SEQ ID NO: 9250 - RNA, 51 nt, Artificial Sequence
  Description of Artificial Sequence: Synthetic oligonucleotide
gggaggacgaugcggugcguuacaugauugugcgccagacgacucgcccga

SEQ ID NO: 9251 - RNA, 51 nt, Artificial Sequence
  Description of Artificial Sequence: Synthetic oligonucleotide
gggaggacgaugcggugacucgucugcuucguccccagacgacucgcccga

SEQ ID NO: 9252 - RNA, 51 nt, Artificial Sequence
  Description of Artificial Sequence: Synthetic oligonucleotide
gggaggacgaugcgguccuuguacguucuaccccccagacgacucgcccga

SEQ ID NO: 9253 - RNA, 52 nt, Artificial Sequence
  Description of Artificial Sequence: Synthetic oligonucleotide
gggaggacgaugcgguuggguguagggugguacccgcagacgacucgcccga

SEQ ID NO: 9254 - RNA, 51 nt, Artificial Sequence
  Description of Artificial Sequence: Synthetic oligonucleotide
gggaggacgaugcggauacuguuugcgugcugccccagacgacucgcccga

SEQ ID NO: 9255 - RNA, 51 nt, Artificial Sequence
  Description of Artificial Sequence: Synthetic oligonucleotide
gggaggacgaugcgggucauuguugucuguugccccagacgacucgcccga

SEQ ID NO: 9256 - RNA, 51 nt, Artificial Sequence
  Description of Artificial Sequence: Synthetic oligonucleotide
gggaggacgaugcggaccguaucguauugugugugcagacgacucgcccga

SEQ ID NO: 9257 - RNA, 51 nt, Artificial Sequence
  Description of Artificial Sequence: Synthetic oligonucleotide
gggaggacgaugcgguacugucgucuguucguccccagacgacucgcccga

SEQ ID NO: 9258 - RNA, 51 nt, Artificial Sequence
  Description of Artificial Sequence: Synthetic oligonucleotide
gggaggacgaugcgguuuccucguguucgugugugcagacgacucgcccga

SEQ ID NO: 9259 - RNA, 51 nt, Artificial Sequence
  Description of Artificial Sequence: Synthetic oligonucleotide
gggaggacgaugcggcgacacgcuuaauauggcugcagacgacucgcccga

SEQ ID NO: 9260 - RNA, 51 nt, Artificial Sequence
  Description of Artificial Sequence: Synthetic oligonucleotide
gggaggacgaugcggcacacgcuauuccccgucugcagacgacucgcccga

SEQ ID NO: 9261 - RNA, 51 nt, Artificial Sequence
  Description of Artificial Sequence: Synthetic oligonucleotide
gggaggacgaugcgguuugguguagggagguacugcagacgacucgcccga

SEQ ID NO: 9262 - RNA, 51 nt, Artificial Sequence
  Description of Artificial Sequence: Synthetic oligonucleotide
gggaggacgaugcggacaguguguucugccuugugcagacgacucgcccga

SEQ ID NO: 9263 - RNA, 51 nt, Artificial Sequence
  Description of Artificial Sequence: Synthetic oligonucleotide
gggaggacgaugcggaaccucucugucguugagugcagacgacucgcccga

SEQ ID NO: 9264 - RNA, 51 nt, Artificial Sequence
  Description of Artificial Sequence: Synthetic oligonucleotide
gggaggacgaugcgggucuuucgacgucuugguaccagacgacucgcccga

SEQ ID NO: 9265 - RNA, 50 nt, Artificial Sequence
  Description of Artificial Sequence: Synthetic oligonucleotide
gggaggacgaugcggucacugauggguuguacugcagacgacucgcccga

SEQ ID NO: 9266 - RNA, 51 nt, Artificial Sequence
  Description of Artificial Sequence: Synthetic oligonucleotide
gggaggacgaugcgguccaucaacaacuugcuccgcagacgacucgcccga

SEQ ID NO: 9267 - RNA, 51 nt, Artificial Sequence
  Description of Artificial Sequence: Synthetic oligonucleotide
gggaggacgaugcgguugcauugcuccugcgugugcagacgacucgcccga

SEQ ID NO: 9268 - RNA, 51 nt, Artificial Sequence
  Description of Artificial Sequence: Synthetic oligonucleotide
gggaggacgaugcgguguagggggguaguuaucgucagacgacucgcccga

SEQ ID NO: 9269 - RNA, 51 nt, Artificial Sequence
  Description of Artificial Sequence: Synthetic oligonucleotide
gggaggacgaugcgguucgaggggugauggguccgcagacgacucgcccga

SEQ ID NO: 9270 - RNA, 51 nt, Artificial Sequence
  Description of Artificial Sequence: Synthetic oligonucleotide
gggaggacgaugcgguuaaguguagggugguaccgcagacgacucgcccga

SEQ ID NO: 9271 - RNA, 50 nt, Artificial Sequence
  Description of Artificial Sequence: Synthetic oligonucleotide
gggaggacgaugcggauuggugaagggagguacgcagacgacucgcccga

SEQ ID NO: 9272 - RNA, 51 nt, Artificial Sequence
  Description of Artificial Sequence: Synthetic oligonucleotide
gggaggacgaugcgguuugaagggggaugguaccgcagacgacucgcccga

SEQ ID NO: 9273 - RNA, 51 nt, Artificial Sequence
  Description of Artificial Sequence: Synthetic oligonucleotide
gggaggacgaugcgguugggaguaggguggaaccgcagacgacucgcccga

SEQ ID NO: 9274 - RNA, 51 nt, Artificial Sequence
  Description of Artificial Sequence: Synthetic oligonucleotide
gggaggacgaugcgguuugaagggcgaugaguccgcagacgacucgcccga

SEQ ID NO: 9275 - RNA, 51 nt, Artificial Sequence
  Description of Artificial Sequence: Synthetic oligonucleotide
gggaggacgaugcggaucaguguaaaguuugugugcagacgacucgcccga

SEQ ID NO: 9276 - RNA, 51 nt, Artificial Sequence
  Description of Artificial Sequence: Synthetic oligonucleotide
gggaggacgaugcgguccugucgucugucuguccccagacgacucgcccga

SEQ ID NO: 9277 - RNA, 51 nt, Artificial Sequence
  Description of Artificial Sequence: Synthetic oligonucleotide
gggaggacgaugcgguuuggugaagggugguaccgcagacgacucgcccga

SEQ ID NO: 9278 - RNA, 51 nt, Artificial Sequence
  Description of Artificial Sequence: Synthetic oligonucleotide
gggaggacgaugcggauaguugucuuguguuugugcagacgacucgcccga

SEQ ID NO: 9279 - RNA, 51 nt, Artificial Sequence
  Description of Artificial Sequence: Synthetic oligonucleotide
gggaggacgaugcggauugaagggagauggguccgcagacgacucgcccga

SEQ ID NO: 9280 - RNA, 51 nt, Artificial Sequence
  Description of Artificial Sequence: Synthetic oligonucleotide
gggaggacgaugcggugguugguacgagggcugugcagacgacucgcccga

SEQ ID NO: 9281 - RNA, 51 nt, Artificial Sequence
  Description of Artificial Sequence: Synthetic oligonucleotide
gggaggacgaugcgguauuggcgguguagggaccgcagacgacucgcccga

SEQ ID NO: 9282 - RNA, 51 nt, Artificial Sequence
  Description of Artificial Sequence: Synthetic oligonucleotide
gggaggacgaugcgggcuugucuucuguucguccccagacgacucgcccga

SEQ ID NO: 9283 - RNA, 51 nt, Artificial Sequence
  Description of Artificial Sequence: Synthetic oligonucleotide
gggaggacgaugcggcgugacuuuccuccggucgccagacgacucgcccga

SEQ ID NO: 9284 - RNA, 51 nt, Artificial Sequence
  Description of Artificial Sequence: Synthetic oligonucleotide
gggaggacgaugcggguuuccgauggugguguggccagacgacucgcccga

SEQ ID NO: 9285 - RNA, 51 nt, Artificial Sequence
  Description of Artificial Sequence: Synthetic oligonucleotide
gggaggacgaugcgguuugaugggugaugggaccgcagacgacucgcccga

SEQ ID NO: 9286 - RNA, 50 nt, Artificial Sequence
  Description of Artificial Sequence: Synthetic oligonucleotide
gggaggacgaugcggucaacguucgucuccuggccagacgacucgcccga

SEQ ID NO: 9287 - RNA, 51 nt, Artificial Sequence
  Description of Artificial Sequence: Synthetic oligonucleotide
gggaggacgaugcgguauucucuucccugucgcaccagacgacucgcccga

SEQ ID NO: 9288 - RNA, 51 nt, Artificial Sequence
  Description of Artificial Sequence: Synthetic oligonucleotide
gggaggacgaugcgguuugguccucgccgagucaccagacgacucgcccga

SEQ ID NO: 9289 - RNA, 51 nt, Artificial Sequence
  Description of Artificial Sequence: Synthetic oligonucleotide
gggaggacgaugcggccaccgugaaaaugugugcccagacgacucgcccga

SEQ ID NO: 9290 - RNA, 51 nt, Artificial Sequence
  Description of Artificial Sequence: Synthetic oligonucleotide
gggaggacgaugcgguguucccugcaaaucgugugcagacgacucgcccga

SEQ ID NO: 9291 - RNA, 51 nt, Artificial Sequence
  Description of Artificial Sequence: Synthetic oligonucleotide
gggaggacgaugcgguuugaagggcgaugcguccgcagacgacucgcccga

SEQ ID NO: 9292 - RNA, 51 nt, Artificial Sequence
  Description of Artificial Sequence: Synthetic oligonucleotide
gggaggacgaugcgguuuggaggguaauggguccgcagacgacucgcccga

SEQ ID NO: 9293 - RNA, 51 nt, Artificial Sequence
  Description of Artificial Sequence: Synthetic oligonucleotide
gggaggacgaugcgguucgauuaugccugccaccccagacgacucgcccga

SEQ ID NO: 9294 - RNA, 51 nt, Artificial Sequence
  Description of Artificial Sequence: Synthetic oligonucleotide
gggaggacgaugcgguuucgcauugguuguggcugcagacgacucgcccga

SEQ ID NO: 9295 - RNA, 52 nt, Artificial Sequence
  Description of Artificial Sequence: Synthetic oligonucleotide
gggaggacgaugcggguccugucgucuguucguucccagacgacucgcccga

SEQ ID NO: 9296 - RNA, 51 nt, Artificial Sequence
  Description of Artificial Sequence: Synthetic oligonucleotide
gggaggacgaugcgguguuggcacuauagcugcugcagacgacucgcccga

SEQ ID NO: 9297 - RNA, 51 nt, Artificial Sequence
  Description of Artificial Sequence: Synthetic oligonucleotide
gggaggacgaugcgguccaccaguucgacucgugccagacgacucgcccga

SEQ ID NO: 9298 - RNA, 51 nt, Artificial Sequence
  Description of Artificial Sequence: Synthetic oligonucleotide
gggaggacgaugcggguacacauugaugauggcgccagacgacucgcccga

SEQ ID NO: 9299 - RNA, 51 nt, Artificial Sequence
  Description of Artificial Sequence: Synthetic oligonucleotide
gggaggacgaugcggcgucagaucguucacguguccagacgacucgcccga

SEQ ID NO: 9300 - RNA, 51 nt, Artificial Sequence
  Description of Artificial Sequence: Synthetic oligonucleotide
gggaggacgaugcgguuuggugaagggugggacugcagacgacucgcccga

SEQ ID NO: 9301 - RNA, 51 nt, Artificial Sequence
  Description of Artificial Sequence: Synthetic oligonucleotide
gggaggacgaugcggauuggagaggggagguacugcagacgacucgcccga

SEQ ID NO: 9302 - RNA, 51 nt, Artificial Sequence
  Description of Artificial Sequence: Synthetic oligonucleotide
gggaggacgaugcggauuggugaaggggggugcugcagacgacucgcccga

SEQ ID NO: 9303 - RNA, 51 nt, Artificial Sequence
  Description of Artificial Sequence: Synthetic oligonucleotide
gggaggacgaugcgguugggugcaggguguuaccgcagacgacucgcccga

SEQ ID NO: 9304 - RNA, 51 nt, Artificial Sequence
  Description of Artificial Sequence: Synthetic oligonucleotide
gggaggacgaugcgguuugcugggugauggguccgcagacgacucgcccga

SEQ ID NO: 9305 - RNA, 51 nt, Artificial Sequence
  Description of Artificial Sequence: Synthetic oligonucleotide
gggaggacgaugcgguuggggguagggugggaccgcagacgacucgcccga

SEQ ID NO: 9306 - RNA, 50 nt, Artificial Sequence
  Description of Artificial Sequence: Synthetic oligonucleotide
gggaggacgaugcgguuugagggggauggguccgcagacgacucgcccga

SEQ ID NO: 9307 - RNA, 49 nt, Artificial Sequence
  Description of Artificial Sequence: Synthetic oligonucleotide
gggaggacgaugcggauuggugaaggguuacugcagacgacucgcccga

SEQ ID NO: 9308 - RNA, 51 nt, Artificial Sequence
  Description of Artificial Sequence: Synthetic oligonucleotide
gggaggacgaugcgguuugaagggugguggggccgcagacgacucgcccga

SEQ ID NO: 9309 - RNA, 51 nt, Artificial Sequence
  Description of Artificial Sequence: Synthetic oligonucleotide
gggaggacgaugcgguuuuaagggagauggguccgcagacgacucgcccga

SEQ ID NO: 9310 - RNA, 51 nt, Artificial Sequence
  Description of Artificial Sequence: Synthetic oligonucleotide
gggaggacgaugcgguuugaagggcaauggguccgcagacgacucgcccga

SEQ ID NO: 9311 - RNA, 51 nt, Artificial Sequence
  Description of Artificial Sequence: Synthetic oligonucleotide
gggaggacgaugcggguugaagggcgauggguccgcagacgacucgcccga

SEQ ID NO: 9312 - RNA, 51 nt, Artificial Sequence
  Description of Artificial Sequence: Synthetic oligonucleotide
gggaggacgaugcggauuggugaggggugggacugcagacgacucgcccga

SEQ ID NO: 9313 - RNA, 51 nt, Artificial Sequence
  Description of Artificial Sequence: Synthetic oligonucleotide
gggaggacgaugcggauuggugaagggcggcacugcagacgacucgcccga

SEQ ID NO: 9314 - RNA, 51 nt, Artificial Sequence
  Description of Artificial Sequence: Synthetic oligonucleotide
gggaggacgaugcgguuugaaaggagauggguccgcagacgacucgcccga

SEQ ID NO: 9315 - RNA, 51 nt, Artificial Sequence
  Description of Artificial Sequence: Synthetic oligonucleotide
gggaggacgaugcgguugggagugggaugggaccgcagacgacucgcccga

SEQ ID NO: 9316 - RNA, 52 nt, Artificial Sequence
  Description of Artificial Sequence: Synthetic oligonucleotide
gggaggacgaugcgggcccuuucguucugcccuccccagacgacucgcccga

SEQ ID NO: 9317 - RNA, 51 nt, Artificial Sequence
  Description of Artificial Sequence: Synthetic oligonucleotide
gggaggacgaugcgguauuggagguauagggaccgcagacgacucgcccga

SEQ ID NO: 9318 - RNA, 52 nt, Artificial Sequence
  Description of Artificial Sequence: Synthetic oligonucleotide
gggaggacgaugcggguccugucgucuuuucguccccagacgacucgcccga

SEQ ID NO: 9319 - RNA, 51 nt, Artificial Sequence
  Description of Artificial Sequence: Synthetic oligonucleotide
gggaggacgaugcggauuggaggagggugggaccgcagacgacucgcccga

SEQ ID NO: 9320 - RNA, 51 nt, Artificial Sequence
  Description of Artificial Sequence: Synthetic oligonucleotide
gggaggacgaugcgguuugaagggugauggguaugcagacgacucgcccga

SEQ ID NO: 9321 - RNA, 51 nt, Artificial Sequence
  Description of Artificial Sequence: Synthetic oligonucleotide
gggaggacgaugcgguuugaagggugauggggccccagacgacucgcccga

SEQ ID NO: 9322 - RNA, 51 nt, Artificial Sequence
  Description of Artificial Sequence: Synthetic oligonucleotide
gggaggacgaugcgguuugccgggugauggguccgcagacgacucgcccga

SEQ ID NO: 9323 - RNA, 51 nt, Artificial Sequence
  Description of Artificial Sequence: Synthetic oligonucleotide
gggaggacgaugcgguuuaaagggagauggguccgcagacgacucgcccga

SEQ ID NO: 9324 - RNA, 51 nt, Artificial Sequence
  Description of Artificial Sequence: Synthetic oligonucleotide
gggaggacgaugcgguugggugugggguguuaccgcagacgacucgcccga

SEQ ID NO: 9325 - RNA, 51 nt, Artificial Sequence
  Description of Artificial Sequence: Synthetic oligonucleotide
gggaggacgaugcgguuugaaggccgauggguccgcagacgacucgcccga

SEQ ID NO: 9326 - RNA, 51 nt, Artificial Sequence
  Description of Artificial Sequence: Synthetic oligonucleotide
gggaggacgaugcggauuggggaagggaggcacugcagacgacucgcccga

SEQ ID NO: 9327 - RNA, 49 nt, Artificial Sequence
  Description of Artificial Sequence: Synthetic oligonucleotide
gggaggacgaugcggauuggugaagggagguaccagacgacucgcccga

SEQ ID NO: 9328 - RNA, 51 nt, Artificial Sequence
  Description of Artificial Sequence: Synthetic oligonucleotide
gggaggacgaugcggauuggcgaagggaggaacugcagacgacucgcccga

SEQ ID NO: 9329 - RNA, 51 nt, Artificial Sequence
  Description of Artificial Sequence: Synthetic oligonucleotide
gggaggacgaugcgguucuccaagugucgugugugcagacgacucgcccga

SEQ ID NO: 9330 - RNA, 51 nt, Artificial Sequence
  Description of Artificial Sequence: Synthetic oligonucleotide
gggaggacgaugcgguugaguacuugucuguuccccagacgacucgcccga

SEQ ID NO: 9331 - RNA, 51 nt, Artificial Sequence
  Description of Artificial Sequence: Synthetic oligonucleotide
gggaggacgaugcggagugggucguauuccgugugcagacgacucgcccga

SEQ ID NO: 9332 - RNA, 51 nt, Artificial Sequence
  Description of Artificial Sequence: Synthetic oligonucleotide
gggaggacgaugcggcagcgucucaucuucgugugcagacgacucgcccga

SEQ ID NO: 9333 - RNA, 51 nt, Artificial Sequence
  Description of Artificial Sequence: Synthetic oligonucleotide
gggaggacgaugcggucguuuguuucugcuccccacagacgacucgcccga

SEQ ID NO: 9334 - RNA, 51 nt, Artificial Sequence
  Description of Artificial Sequence: Synthetic oligonucleotide
gggaggacgaugcggaguccccaacuaguugucugcagacgacucgcccga

SEQ ID NO: 9335 - RNA, 50 nt, Artificial Sequence
  Description of Artificial Sequence: Synthetic oligonucleotide
gggaggacgaugcgguccgcgucuccuucgugcccagacgacucgcccga

SEQ ID NO: 9336 - RNA, 51 nt, Artificial Sequence
  Description of Artificial Sequence: Synthetic oligonucleotide
gggaggacgaugcgguucgucguuccuuucccccccagacgacucgcccga

SEQ ID NO: 9337 - RNA, 51 nt, Artificial Sequence
  Description of Artificial Sequence: Synthetic oligonucleotide
gggaggacgaugcggugaguauuucuguucccccccagacgacucgcccga

SEQ ID NO: 9338 - RNA, 51 nt, Artificial Sequence
  Description of Artificial Sequence: Synthetic oligonucleotide
gggaggacgaugcggcagucguuuuaccgcgugugcagacgacucgcccga

SEQ ID NO: 9339 - RNA, 51 nt, Artificial Sequence
  Description of Artificial Sequence: Synthetic oligonucleotide
gggaggacgaugcgguuuggaggaggaugguaccgcagacgacucgcccga

SEQ ID NO: 9340 - RNA, 51 nt, Artificial Sequence
  Description of Artificial Sequence: Synthetic oligonucleotide
gggaggacgaugcgggugaaguucucuugcguugccagacgacucgcccga

SEQ ID NO: 9341 - RNA, 51 nt, Artificial Sequence
  Description of Artificial Sequence: Synthetic oligonucleotide
gggaggacgaugcggcaucuguccaguccgguagccagacgacucgcccga

SEQ ID NO: 9342 - RNA, 51 nt, Artificial Sequence
  Description of Artificial Sequence: Synthetic oligonucleotide
gggaggacgaugcgggucgccuugaaugacugcgccagacgacucgcccga

SEQ ID NO: 9343 - RNA, 51 nt, Artificial Sequence
  Description of Artificial Sequence: Synthetic oligonucleotide
gggaggacgaugcgguuuaugccucucacgugcugcagacgacucgcccga

SEQ ID NO: 9344 - RNA, 51 nt, Artificial Sequence
  Description of Artificial Sequence: Synthetic oligonucleotide
gggaggacgaugcggacgucgaacucccgugucgccagacgacucgcccga

SEQ ID NO: 9345 - RNA, 51 nt, Artificial Sequence
  Description of Artificial Sequence: Synthetic oligonucleotide
gggaggacgaugcgguuguagucguuuucauucgccagacgacucgcccga

SEQ ID NO: 9346 - RNA, 51 nt, Artificial Sequence
  Description of Artificial Sequence: Synthetic oligonucleotide
gggaggacgaugcggugccucuguccguucgugugcagacgacucgcccga

SEQ ID NO: 9347 - RNA, 51 nt, Artificial Sequence
  Description of Artificial Sequence: Synthetic oligonucleotide
gggaggacgaugcggauggcuguucguucgcuccccagacgacucgcccga

SEQ ID NO: 9348 - RNA, 51 nt, Artificial Sequence
  Description of Artificial Sequence: Synthetic oligonucleotide
gggaggacgaugcgggugaggaaaucauugugcaccagacgacucgcccga

SEQ ID NO: 9349 - RNA, 51 nt, Artificial Sequence
  Description of Artificial Sequence: Synthetic oligonucleotide
gggaggacgaugcgguggacguguucccgucugugcagacgacucgcccga

SEQ ID NO: 9350 - RNA, 51 nt, Artificial Sequence
  Description of Artificial Sequence: Synthetic oligonucleotide
gggaggacgaugcgguacuauccucccuuggucugcagacgacucgcccga

SEQ ID NO: 9351 - RNA, 51 nt, Artificial Sequence
  Description of Artificial Sequence: Synthetic oligonucleotide
gggaggacgaugcgguccuucgucguuuggcucaccagacgacucgcccga

SEQ ID NO: 9352 - RNA, 51 nt, Artificial Sequence
  Description of Artificial Sequence: Synthetic oligonucleotide
gggaggacgaugcggcuggguguagggagguaccgcagacgacucgcccga

SEQ ID NO: 9353 - RNA, 51 nt, Artificial Sequence
  Description of Artificial Sequence: Synthetic oligonucleotide
gggaggacgaugcgguagagugucucacuccugugcagacgacucgcccga

SEQ ID NO: 9354 - RNA, 51 nt, Artificial Sequence
  Description of Artificial Sequence: Synthetic oligonucleotide
gggaggacgaugcgguuacucguccacauugugcccagacgacucgcccga

SEQ ID NO: 9355 - RNA, 51 nt, Artificial Sequence
  Description of Artificial Sequence: Synthetic oligonucleotide
gggaggacgaugcggcaacacguucucuugucgugcagacgacucgcccga

SEQ ID NO: 9356 - RNA, 51 nt, Artificial Sequence
  Description of Artificial Sequence: Synthetic oligonucleotide
gggaggacgaugcgguuagucgaggccacuugugccagacgacucgcccga

SEQ ID NO: 9357 - RNA, 51 nt, Artificial Sequence
  Description of Artificial Sequence: Synthetic oligonucleotide
gggaggacgaugcgguaaaggugagggucgcuguccagacgacucgcccga

SEQ ID NO: 9358 - RNA, 51 nt, Artificial Sequence
  Description of Artificial Sequence: Synthetic oligonucleotide
gggaggacgaugcggacccuccacagucguuuggucagacgacucgcccga

SEQ ID NO: 9359 - RNA, 51 nt, Artificial Sequence
  Description of Artificial Sequence: Synthetic oligonucleotide
gggaggacgaugcggccguucgcuuauucuccccccagacgacucgcccga

SEQ ID NO: 9360 - RNA, 51 nt, Artificial Sequence
  Description of Artificial Sequence: Synthetic oligonucleotide
gggaggacgaugcggugacuucccagaaccaucgccagacgacucgcccga

SEQ ID NO: 9361 - RNA, 52 nt, Artificial Sequence
  Description of Artificial Sequence: Synthetic oligonucleotide
gggaggacgaugcgggccuucguuuugguucguccccagacgacucgcccga

SEQ ID NO: 9362 - RNA, 51 nt, Artificial Sequence
  Description of Artificial Sequence: Synthetic oligonucleotide
gggaggacgaugcggccgcacauuccuccgugguacagacgacucgcccga

SEQ ID NO: 9363 - RNA, 51 nt, Artificial Sequence
  Description of Artificial Sequence: Synthetic oligonucleotide
gggaggacgaugcgguauaggagguguagggaccgcagacgacucgcccga

SEQ ID NO: 9364 - RNA, 51 nt, Artificial Sequence
  Description of Artificial Sequence: Synthetic oligonucleotide
gggaggacgaugcggcuccgaauuccccgucugcccagacgacucgcccga

SEQ ID NO: 9365 - RNA, 51 nt, Artificial Sequence
  Description of Artificial Sequence: Synthetic oligonucleotide
gggaggacgaugcggggccauuguguuggugugugcagacgacucgcccga

SEQ ID NO: 9366 - RNA, 51 nt, Artificial Sequence
  Description of Artificial Sequence: Synthetic oligonucleotide
gggaggacgaugcggaaaagggaugacucguggugcagacgacucgcccga

SEQ ID NO: 9367 - RNA, 51 nt, Artificial Sequence
  Description of Artificial Sequence: Synthetic oligonucleotide
gggaggacgaugcggucagucguacugagucuguccagacgacucgcccga

SEQ ID NO: 9368 - RNA, 51 nt, Artificial Sequence
  Description of Artificial Sequence: Synthetic oligonucleotide
gggaggacgaugcggaaguccaucgaucguuggugcagacgacucgcccga

SEQ ID NO: 9369 - RNA, 51 nt, Artificial Sequence
  Description of Artificial Sequence: Synthetic oligonucleotide
gggaggacgaugcggaaugaggaggagguggugcgcagacgacucgcccga

SEQ ID NO: 9370 - RNA, 51 nt, Artificial Sequence
  Description of Artificial Sequence: Synthetic oligonucleotide
gggaggacgaugcggcuuaguuaauuguuguugugcagacgacucgcccga

SEQ ID NO: 9371 - RNA, 51 nt, Artificial Sequence
  Description of Artificial Sequence: Synthetic oligonucleotide
gggaggacgaugcgggcuguuuccucuguucccaccagacgacucgcccga

SEQ ID NO: 9372 - RNA, 51 nt, Artificial Sequence
  Description of Artificial Sequence: Synthetic oligonucleotide
gggaggacgaugcggugccgaauguccugugaccccagacgacucgcccga

SEQ ID NO: 9373 - RNA, 51 nt, Artificial Sequence
  Description of Artificial Sequence: Synthetic oligonucleotide
gggaggacgaugcggaucgcuguucuccauguccucagacgacucgcccga

SEQ ID NO: 9374 - RNA, 51 nt, Artificial Sequence
  Description of Artificial Sequence: Synthetic oligonucleotide
gggaggacgaugcggauccucugaucgucgaucgccagacgacucgcccga

SEQ ID NO: 9375 - RNA, 51 nt, Artificial Sequence
  Description of Artificial Sequence: Synthetic oligonucleotide
gggaggacgaugcggauugacuacccuuaccgcgucagacgacucgcccga

SEQ ID NO: 9376 - RNA, 51 nt, Artificial Sequence
  Description of Artificial Sequence: Synthetic oligonucleotide
gggaggacgaugcgguccuugaguugguuaggccccagacgacucgcccga

SEQ ID NO: 9377 - RNA, 51 nt, Artificial Sequence
  Description of Artificial Sequence: Synthetic oligonucleotide
gggaggacgaugcggugccguuuguaacuggucugcagacgacucgcccga

SEQ ID NO: 9378 - RNA, 51 nt, Artificial Sequence
  Description of Artificial Sequence: Synthetic oligonucleotide
gggaggacgaugcgggugacuuguccuguguugugcagacgacucgcccga

SEQ ID NO: 9379 - RNA, 51 nt, Artificial Sequence
  Description of Artificial Sequence: Synthetic oligonucleotide
gggaggacgaugcggugacaacuccccugcaacugcagacgacucgcccga

SEQ ID NO: 9380 - RNA, 50 nt, Artificial Sequence
  Description of Artificial Sequence: Synthetic oligonucleotide
gggaggacgaugcgguucuacgucugucccggugcagacgacucgcccga

SEQ ID NO: 9381 - RNA, 51 nt, Artificial Sequence
  Description of Artificial Sequence: Synthetic oligonucleotide
gggaggacgaugcgguauccgggaggaacggugugcagacgacucgcccga

SEQ ID NO: 9382 - RNA, 51 nt, Artificial Sequence
  Description of Artificial Sequence: Synthetic oligonucleotide
gggaggacgaugcgggcauugugauggugcggcugcagacgacucgcccga

SEQ ID NO: 9383 - RNA, 51 nt, Artificial Sequence
  Description of Artificial Sequence: Synthetic oligonucleotide
gggaggacgaugcgguugaauggguaacacuggugcagacgacucgcccga

SEQ ID NO: 9384 - RNA, 51 nt, Artificial Sequence
  Description of Artificial Sequence: Synthetic oligonucleotide
gggaggacgaugcggcguacucgucuauucccccccagacgacucgcccga

SEQ ID NO: 9385 - RNA, 52 nt, Artificial Sequence
  Description of Artificial Sequence: Synthetic oligonucleotide
gggaggacgaugcggauccugucgucuguucguccccagacgacucgcccga

SEQ ID NO: 9386 - RNA, 50 nt, Artificial Sequence
  Description of Artificial Sequence: Synthetic oligonucleotide
gggaggacgaugcgguuggguguagggaguuccgcagacgacucgcccga

SEQ ID NO: 9387 - RNA, 50 nt, Artificial Sequence
  Description of Artificial Sequence: Synthetic oligonucleotide
gggaggacgaugcggauuggugaagggaguaccgcagacgacucgcccga

SEQ ID NO: 9388 - RNA, 51 nt, Artificial Sequence
  Description of Artificial Sequence: Synthetic oligonucleotide
gggaggacgaugcggcuugaagggugaugggcccgcagacgacucgcccga

SEQ ID NO: 9389 - RNA, 51 nt, Artificial Sequence
  Description of Artificial Sequence: Synthetic oligonucleotide
gggaggacgaugcggacuugugguuaugaccccgccagacgacucgcccga

SEQ ID NO: 9390 - RNA, 51 nt, Artificial Sequence
  Description of Artificial Sequence: Synthetic oligonucleotide
gggaggacgaugcggccuuguuucguccugcuggccagacgacucgcccga

SEQ ID NO: 9391 - RNA, 51 nt, Artificial Sequence
  Description of Artificial Sequence: Synthetic oligonucleotide
gggaggacgaugcgguauaacucauguugucuggccagacgacucgcccga

SEQ ID NO: 9392 - RNA, 51 nt, Artificial Sequence
  Description of Artificial Sequence: Synthetic oligonucleotide
gggaggacgaugcggcccgugcaucguguacugugcagacgacucgcccga

SEQ ID NO: 9393 - RNA, 51 nt, Artificial Sequence
  Description of Artificial Sequence: Synthetic oligonucleotide
gggaggacgaugcgguuuaaagggggauggguccgcagacgacucgcccga

SEQ ID NO: 9394 - RNA, 51 nt, Artificial Sequence
  Description of Artificial Sequence: Synthetic oligonucleotide
gggaggacgaugcgguuccuuucgcgcguugucugcagacgacucgcccga

SEQ ID NO: 9395 - RNA, 51 nt, Artificial Sequence
  Description of Artificial Sequence: Synthetic oligonucleotide
gggaggacgaugcggagccguaguagucuguugcccagacgacucgcccga

SEQ ID NO: 9396 - RNA, 51 nt, Artificial Sequence
  Description of Artificial Sequence: Synthetic oligonucleotide
gggaggacgaugcggucuuucucgucuccuggcgucagacgacucgcccga

SEQ ID NO: 9397 - RNA, 51 nt, Artificial Sequence
  Description of Artificial Sequence: Synthetic oligonucleotide
gggaggacgaugcggugagcgucagcuguucgcgccagacgacucgcccga

SEQ ID NO: 9398 - RNA, 51 nt, Artificial Sequence
  Description of Artificial Sequence: Synthetic oligonucleotide
gggaggacgaugcggcaaaacguccguucuggcugcagacgacucgcccga

SEQ ID NO: 9399 - RNA, 51 nt, Artificial Sequence
  Description of Artificial Sequence: Synthetic oligonucleotide
gggaggacgaugcggugucuucccugcggguuguccagacgacucgcccga

SEQ ID NO: 9400 - RNA, 51 nt, Artificial Sequence
  Description of Artificial Sequence: Synthetic oligonucleotide
gggaggacgaugcggcguaaugcagucuguggcugcagacgacucgcccga

SEQ ID NO: 9401 - RNA, 51 nt, Artificial Sequence
  Description of Artificial Sequence: Synthetic oligonucleotide
gggaggacgaugcggucaucuaggucucacuggcccagacgacucgcccga

SEQ ID NO: 9402 - RNA, 51 nt, Artificial Sequence
  Description of Artificial Sequence: Synthetic oligonucleotide
gggaggacgaugcgguuucgucgugccgccgugugcagacgacucgcccga

SEQ ID NO: 9403 - RNA, 51 nt, Artificial Sequence
  Description of Artificial Sequence: Synthetic oligonucleotide
gggaggacgaugcggcgaugaauugacguguugugcagacgacucgcccga

SEQ ID NO: 9404 - RNA, 51 nt, Artificial Sequence
  Description of Artificial Sequence: Synthetic oligonucleotide
gggaggacgaugcggccaguagucuguucagugugcagacgacucgcccga

SEQ ID NO: 9405 - RNA, 51 nt, Artificial Sequence
  Description of Artificial Sequence: Synthetic oligonucleotide
gggaggacgaugcggacagucgggaucuguguggccagacgacucgcccga

SEQ ID NO: 9406 - RNA, 51 nt, Artificial Sequence
  Description of Artificial Sequence: Synthetic oligonucleotide
gggaggacgaugcgguuucaaaagcguaauugcugcagacgacucgcccga

SEQ ID NO: 9407 - RNA, 51 nt, Artificial Sequence
  Description of Artificial Sequence: Synthetic oligonucleotide
gggaggacgaugcggauucgcucccauccguucgccagacgacucgcccga

SEQ ID NO: 9408 - RNA, 52 nt, Artificial Sequence
  Description of Artificial Sequence: Synthetic oligonucleotide
gggaggacgaugcgguuggguguaggggugguaccgcagacgacucgcccga

SEQ ID NO: 9409 - RNA, 51 nt, Artificial Sequence
  Description of Artificial Sequence: Synthetic oligonucleotide
gggaggacgaugcggguaaacagucgucgccccuccagacgacucgcccga

SEQ ID NO: 9410 - RNA, 51 nt, Artificial Sequence
  Description of Artificial Sequence: Synthetic oligonucleotide
gggaggacgaugcggucgaugucgaguuacauccgcagacgacucgcccga

SEQ ID NO: 9411 - RNA, 51 nt, Artificial Sequence
  Description of Artificial Sequence: Synthetic oligonucleotide
gggaggacgaugcggccuuacugacucccgguugccagacgacucgcccga

SEQ ID NO: 9412 - RNA, 51 nt, Artificial Sequence
  Description of Artificial Sequence: Synthetic oligonucleotide
gggaggacgaugcgguucgggucuguucgccugugcagacgacucgcccga

SEQ ID NO: 9413 - RNA, 52 nt, Artificial Sequence
  Description of Artificial Sequence: Synthetic oligonucleotide
gggaggacgaugcgguuugaagggugauagguacugcagacgacucgcccga

SEQ ID NO: 9414 - RNA, 51 nt, Artificial Sequence
  Description of Artificial Sequence: Synthetic oligonucleotide
gggaggacgaugcggauucgucacucugcugcugccagacgacucgcccga

SEQ ID NO: 9415 - RNA, 52 nt, Artificial Sequence
  Description of Artificial Sequence: Synthetic oligonucleotide
gggaggacgaugcggguccugucgucuguucgcccccagacgacucgcccga

SEQ ID NO: 9416 - RNA, 51 nt, Artificial Sequence
  Description of Artificial Sequence: Synthetic oligonucleotide
gggaggacgaugcgguugggagggggaugguaccgcagacgacucgcccga

SEQ ID NO: 9417 - RNA, 51 nt, Artificial Sequence
  Description of Artificial Sequence: Synthetic oligonucleotide
gggaggacgaugcggcagaggagaagggaguuugccagacgacucgcccga

SEQ ID NO: 9418 - RNA, 52 nt, Artificial Sequence
  Description of Artificial Sequence: Synthetic oligonucleotide
gggaggacgaugcggcuugucgucuuguucgucccccagacgacucgcccga

SEQ ID NO: 9419 - RNA, 51 nt, Artificial Sequence
  Description of Artificial Sequence: Synthetic oligonucleotide
gggaggacgaugcggauuggcgaagggagggacugcagacgacucgcccga

SEQ ID NO: 9420 - RNA, 51 nt, Artificial Sequence
  Description of Artificial Sequence: Synthetic oligonucleotide
gggaggacgaugcgguuugaagggugguggguccacagacgacucgcccga

SEQ ID NO: 9421 - RNA, 51 nt, Artificial Sequence
  Description of Artificial Sequence: Synthetic oligonucleotide
gggaggacgaugcgguuugaagggugguggguacgcagacgacucgcccga

SEQ ID NO: 9422 - RNA, 51 nt, Artificial Sequence
  Description of Artificial Sequence: Synthetic oligonucleotide
gggaggacgaugcgguuggguggggggugggaccgcagacgacucgcccga

SEQ ID NO: 9423 - RNA, 51 nt, Artificial Sequence
  Description of Artificial Sequence: Synthetic oligonucleotide
gggaggacgaugcgguauacggcgguguggggguacagacgacucgcccga

SEQ ID NO: 9424 - RNA, 51 nt, Artificial Sequence
  Description of Artificial Sequence: Synthetic oligonucleotide
gggaggacgaugcggauuggugaagggugggaccgcagacgacucgcccga

SEQ ID NO: 9425 - RNA, 51 nt, Artificial Sequence
  Description of Artificial Sequence: Synthetic oligonucleotide
gggaggacgaugcgguuugaaguuugauggguccgcagacgacucgcccga

SEQ ID NO: 9426 - RNA, 51 nt, Artificial Sequence
  Description of Artificial Sequence: Synthetic oligonucleotide
gggaggacgaugcggugacuugucuguuucguccccagacgacucgcccga

SEQ ID NO: 9427 - RNA, 51 nt, Artificial Sequence
  Description of Artificial Sequence: Synthetic oligonucleotide
gggaggacgaugcgguuugaagggagaugcguccgcagacgacucgcccga

SEQ ID NO: 9428 - RNA, 50 nt, Artificial Sequence
  Description of Artificial Sequence: Synthetic oligonucleotide
gggaggacgaugcgguuugaaggggguggguccgcagacgacucgcccga

SEQ ID NO: 9429 - RNA, 51 nt, Artificial Sequence
  Description of Artificial Sequence: Synthetic oligonucleotide
gggaggacgaugcggguaauugugugagccguccccagacgacucgcccga

SEQ ID NO: 9430 - RNA, 50 nt, Artificial Sequence
  Description of Artificial Sequence: Synthetic oligonucleotide
gggaggacgaugcgguguagggagguaguuaugucagacgacucgcccga

SEQ ID NO: 9431 - RNA, 51 nt, Artificial Sequence
  Description of Artificial Sequence: Synthetic oligonucleotide
gggaggacgaugcggcuugucgccuuguucguccccagacgacucgcccga

SEQ ID NO: 9432 - RNA, 51 nt, Artificial Sequence
  Description of Artificial Sequence: Synthetic oligonucleotide
gggaggacgaugcgguuggaagggugaugggaccgcagacgacucgcccga

SEQ ID NO: 9433 - RNA, 49 nt, Artificial Sequence
  Description of Artificial Sequence: Synthetic oligonucleotide
gggaggacgaugcggcgguguagggugguaccgcagacgacucgcccga

SEQ ID NO: 9434 - RNA, 51 nt, Artificial Sequence
  Description of Artificial Sequence: Synthetic oligonucleotide
gggaggacgaugcggcuugucguccuguucguccccagacgacucgcccga

SEQ ID NO: 9435 - RNA, 51 nt, Artificial Sequence
  Description of Artificial Sequence: Synthetic oligonucleotide
gggaggacgaugcggauuggugaaggaagggacugcagacgacucgcccga

SEQ ID NO: 9436 - RNA, 51 nt, Artificial Sequence
  Description of Artificial Sequence: Synthetic oligonucleotide
gggaggacgaugcgguuugacgggugaugggcccgcagacgacucgcccga

SEQ ID NO: 9437 - RNA, 50 nt, Artificial Sequence
  Description of Artificial Sequence: Synthetic oligonucleotide
gggaggacgaugcggcguuccucugguucguccccagacgacucgcccga

SEQ ID NO: 9438 - RNA, 51 nt, Artificial Sequence
  Description of Artificial Sequence: Synthetic oligonucleotide
gggaggacgaugcgguccguaaccuccccgugcugcagacgacucgcccga

SEQ ID NO: 9439 - RNA, 51 nt, Artificial Sequence
  Description of Artificial Sequence: Synthetic oligonucleotide
gggaggacgaugcgguguagggggaggagggaccgcagacgacucgcccga

SEQ ID NO: 9440 - RNA, 51 nt, Artificial Sequence
  Description of Artificial Sequence: Synthetic oligonucleotide
gggaggacgaugcgguuugaaggagggugguaccgcagacgacucgcccga

SEQ ID NO: 9441 - RNA, 51 nt, Artificial Sequence
  Description of Artificial Sequence: Synthetic oligonucleotide
gggaggacgaugcggcugaucguuugggugugccccagacgacucgcccga

SEQ ID NO: 9442 - RNA, 51 nt, Artificial Sequence
  Description of Artificial Sequence: Synthetic oligonucleotide
gggaggacgaugcgguuugauggguguuggguccgcagacgacucgcccga

SEQ ID NO: 9443 - RNA, 51 nt, Artificial Sequence
  Description of Artificial Sequence: Synthetic oligonucleotide
gggaggacgaugcgguugggugcagggggguaccgcagacgacucgcccga

SEQ ID NO: 9444 - RNA, 50 nt, Artificial Sequence
  Description of Artificial Sequence: Synthetic oligonucleotide
gggaggacgaugcgguggguguaggguguuaccgcagacgacucgcccga

SEQ ID NO: 9445 - RNA, 52 nt, Artificial Sequence
  Description of Artificial Sequence: Synthetic oligonucleotide
gggaggacgaugcgguugggguguagggugguaccgcagacgacucgcccga

SEQ ID NO: 9446 - RNA, 51 nt, Artificial Sequence
  Description of Artificial Sequence: Synthetic oligonucleotide
gggaggacgaugcgguuugaagggcgaaggguccgcagacgacucgcccga

SEQ ID NO: 9447 - RNA, 51 nt, Artificial Sequence
  Description of Artificial Sequence: Synthetic oligonucleotide
gggaggacgaugcgguugggcguagggugggaccgcagacgacucgcccga

SEQ ID NO: 9448 - RNA, 51 nt, Artificial Sequence
  Description of Artificial Sequence: Synthetic oligonucleotide
gggaggacgaugcggcuugaagggugaugggucugcagacgacucgcccga

SEQ ID NO: 9449 - RNA, 52 nt, Artificial Sequence
  Description of Artificial Sequence: Synthetic oligonucleotide
gggaggacgaugcgguuugaagggugauuggguccucagacgacucgcccga

SEQ ID NO: 9450 - RNA, 51 nt, Artificial Sequence
  Description of Artificial Sequence: Synthetic oligonucleotide
gggaggacgaugcgguuuggagggugaugggucugcagacgacucgcccga

SEQ ID NO: 9451 - RNA, 51 nt, Artificial Sequence
  Description of Artificial Sequence: Synthetic oligonucleotide
gggaggacgaugcgguuugaagggggauggguccucagacgacucgcccga

SEQ ID NO: 9452 - RNA, 51 nt, Artificial Sequence
  Description of Artificial Sequence: Synthetic oligonucleotide
gggaggacgaugcgguucgaagggugauggguccccagacgacucgcccga

SEQ ID NO: 9453 - RNA, 51 nt, Artificial Sequence
  Description of Artificial Sequence: Synthetic oligonucleotide
gggaggacgaugcgguacucagucgucuuauacugcagacgacucgcccga

SEQ ID NO: 9454 - RNA, 51 nt, Artificial Sequence
  Description of Artificial Sequence: Synthetic oligonucleotide
gggaggacgaugcggguagaaucgucgcggcugcccagacgacucgcccga

SEQ ID NO: 9455 - RNA, 51 nt, Artificial Sequence
  Description of Artificial Sequence: Synthetic oligonucleotide
gggaggacgaugcgguccuggccugucguuguccccagacgacucgcccga

SEQ ID NO: 9456 - RNA, 51 nt, Artificial Sequence
  Description of Artificial Sequence: Synthetic oligonucleotide
gggaggacgaugcggauauagugugagccguuugccagacgacucgcccga

SEQ ID NO: 9457 - RNA, 51 nt, Artificial Sequence
  Description of Artificial Sequence: Synthetic oligonucleotide
gggaggacgaugcggaagaccgaaugugugugcugcagacgacucgcccga

SEQ ID NO: 9458 - RNA, 51 nt, Artificial Sequence
  Description of Artificial Sequence: Synthetic oligonucleotide
gggaggacgaugcgguuugaagguugguggguccgcagacgacucgcccga

SEQ ID NO: 9459 - RNA, 51 nt, Artificial Sequence
  Description of Artificial Sequence: Synthetic oligonucleotide
gggaggacgaugcggaugacaauuggguacuggugcagacgacucgcccga

SEQ ID NO: 9460 - RNA, 51 nt, Artificial Sequence
  Description of Artificial Sequence: Synthetic oligonucleotide
gggaggacgaugcgggauucgaucugucaccuccccagacgacucgcccga

SEQ ID NO: 9461 - RNA, 51 nt, Artificial Sequence
  Description of Artificial Sequence: Synthetic oligonucleotide
gggaggacgaugcgggucguugucaaccguauccccagacgacucgcccga

SEQ ID NO: 9462 - RNA, 51 nt, Artificial Sequence
  Description of Artificial Sequence: Synthetic oligonucleotide
gggaggacgaugcgguucgacuaguaguuggucaccagacgacucgcccga

SEQ ID NO: 9463 - RNA, 51 nt, Artificial Sequence
  Description of Artificial Sequence: Synthetic oligonucleotide
gggaggacgaugcgggcaaguuguugcuacccccccagacgacucgcccga

SEQ ID NO: 9464 - RNA, 51 nt, Artificial Sequence
  Description of Artificial Sequence: Synthetic oligonucleotide
gggaggacgaugcggccguaucuaaccuccaugugcagacgacucgcccga

SEQ ID NO: 9465 - RNA, 51 nt, Artificial Sequence
  Description of Artificial Sequence: Synthetic oligonucleotide
gggaggacgaugcggcauagcguuuggcgaugggccagacgacucgcccga

SEQ ID NO: 9466 - RNA, 51 nt, Artificial Sequence
  Description of Artificial Sequence: Synthetic oligonucleotide
gggaggacgaugcggucgguaaucuuguguagcugcagacgacucgcccga

SEQ ID NO: 9467 - RNA, 51 nt, Artificial Sequence
  Description of Artificial Sequence: Synthetic oligonucleotide
gggaggacgaugcgggccuuucguucugcuccccccagacgacucgcccga

SEQ ID NO: 9468 - RNA, 51 nt, Artificial Sequence
  Description of Artificial Sequence: Synthetic oligonucleotide
gggaggacgaugcggaggugugaugaauauggccccagacgacucgcccga

SEQ ID NO: 9469 - RNA, 51 nt, Artificial Sequence
  Description of Artificial Sequence: Synthetic oligonucleotide
gggaggacgaugcggucggagagcuaacaacaccgcagacgacucgcccga

SEQ ID NO: 9470 - RNA, 51 nt, Artificial Sequence
  Description of Artificial Sequence: Synthetic oligonucleotide
gggaggacgaugcgggaacaacaagucgucacggccagacgacucgcccga

SEQ ID NO: 9471 - RNA, 51 nt, Artificial Sequence
  Description of Artificial Sequence: Synthetic oligonucleotide
gggaggacgaugcgguugggugaagggggguaccgcagacgacucgcccga

SEQ ID NO: 9472 - RNA, 51 nt, Artificial Sequence
  Description of Artificial Sequence: Synthetic oligonucleotide
gggaggacgaugcgguuuggagaagggugguacugcagacgacucgcccga

SEQ ID NO: 9473 - RNA, 51 nt, Artificial Sequence
  Description of Artificial Sequence: Synthetic oligonucleotide
gggaggacgaugcggcaucuaacccagugugugcccagacgacucgcccga

SEQ ID NO: 9474 - RNA, 51 nt, Artificial Sequence
  Description of Artificial Sequence: Synthetic oligonucleotide
gggaggacgaugcggacgaagaucgaugcugugcccagacgacucgcccga

SEQ ID NO: 9475 - RNA, 51 nt, Artificial Sequence
  Description of Artificial Sequence: Synthetic oligonucleotide
gggaggacgaugcgggaauagucggaaugccgcgccagacgacucgcccga

SEQ ID NO: 9476 - RNA, 51 nt, Artificial Sequence
  Description of Artificial Sequence: Synthetic oligonucleotide
gggaggacgaugcggagagcgaugucgguuuggcccagacgacucgcccga

SEQ ID NO: 9477 - RNA, 51 nt, Artificial Sequence
  Description of Artificial Sequence: Synthetic oligonucleotide
gggaggacgaugcggucaccguuuccuccugugcccagacgacucgcccga

SEQ ID NO: 9478 - RNA, 51 nt, Artificial Sequence
  Description of Artificial Sequence: Synthetic oligonucleotide
gggaggacgaugcggcuagucagguguuugggcgccagacgacucgcccga

SEQ ID NO: 9479 - RNA, 51 nt, Artificial Sequence
  Description of Artificial Sequence: Synthetic oligonucleotide
gggaggacgaugcggcaccauaaccgugcggucugcagacgacucgcccga

SEQ ID NO: 9480 - RNA, 51 nt, Artificial Sequence
  Description of Artificial Sequence: Synthetic oligonucleotide
gggaggacgaugcggaauauggcgcccuucacgugcagacgacucgcccga

SEQ ID NO: 9481 - RNA, 51 nt, Artificial Sequence
  Description of Artificial Sequence: Synthetic oligonucleotide
gggaggacgaugcggaucaguuaacgcacagccugcagacgacucgcccga

SEQ ID NO: 9482 - RNA, 51 nt, Artificial Sequence
  Description of Artificial Sequence: Synthetic oligonucleotide
gggaggacgaugcggguaagaggucaaugcuuggccagacgacucgcccga

SEQ ID NO: 9483 - RNA, 51 nt, Artificial Sequence
  Description of Artificial Sequence: Synthetic oligonucleotide
gggaggacgaugcgguccucggguaucgaucugugcagacgacucgcccga

SEQ ID NO: 9484 - RNA, 50 nt, Artificial Sequence
  Description of Artificial Sequence: Synthetic oligonucleotide
gggaggacgaugcgggccuuucguucuuccuccccagacgacucgcccga

SEQ ID NO: 9485 - RNA, 51 nt, Artificial Sequence
  Description of Artificial Sequence: Synthetic oligonucleotide
gggaggacgaugcgggaagcgccugacuaugugcccagacgacucgcccga

SEQ ID NO: 9486 - RNA, 51 nt, Artificial Sequence
  Description of Artificial Sequence: Synthetic oligonucleotide
gggaggacgaugcggaauuguucauucuacaugcccagacgacucgcccga

SEQ ID NO: 9487 - RNA, 51 nt, Artificial Sequence
  Description of Artificial Sequence: Synthetic oligonucleotide
gggaggacgaugcgggugauuguacgucuucuccccagacgacucgcccga

SEQ ID NO: 9488 - RNA, 51 nt, Artificial Sequence
  Description of Artificial Sequence: Synthetic oligonucleotide
gggaggacgaugcggauuggucaagggagguaccgcagacgacucgcccga

SEQ ID NO: 9489 - RNA, 51 nt, Artificial Sequence
  Description of Artificial Sequence: Synthetic oligonucleotide
gggaggacgaugcgggagauugccugcgccuugugcagacgacucgcccga

SEQ ID NO: 9490 - RNA, 51 nt, Artificial Sequence
  Description of Artificial Sequence: Synthetic oligonucleotide
gggaggacgaugcggacgccuuauucugcaggccacagacgacucgcccga

SEQ ID NO: 9491 - RNA, 51 nt, Artificial Sequence
  Description of Artificial Sequence: Synthetic oligonucleotide
gggaggacgaugcgggaguacgugugccguagcugcagacgacucgcccga

SEQ ID NO: 9492 - RNA, 51 nt, Artificial Sequence
  Description of Artificial Sequence: Synthetic oligonucleotide
gggaggacgaugcgguaucgguccuaguccagcgccagacgacucgcccga

SEQ ID NO: 9493 - RNA, 51 nt, Artificial Sequence
  Description of Artificial Sequence: Synthetic oligonucleotide
gggaggacgaugcgguacguucucuccuguggccccagacgacucgcccga

SEQ ID NO: 9494 - RNA, 51 nt, Artificial Sequence
  Description of Artificial Sequence: Synthetic oligonucleotide
gggaggacgaugcggcaguucgcucccacaagccccagacgacucgcccga

SEQ ID NO: 9495 - RNA, 51 nt, Artificial Sequence
  Description of Artificial Sequence: Synthetic oligonucleotide
gggaggacgaugcggucuggggaaauaacgugcugcagacgacucgcccga

SEQ ID NO: 9496 - RNA, 51 nt, Artificial Sequence
  Description of Artificial Sequence: Synthetic oligonucleotide
gggaggacgaugcgggucuucugucuuaccguccccagacgacucgcccga

SEQ ID NO: 9497 - RNA, 51 nt, Artificial Sequence
  Description of Artificial Sequence: Synthetic oligonucleotide
gggaggacgaugcggucccgucccguguauguugccagacgacucgcccga

SEQ ID NO: 9498 - RNA, 51 nt, Artificial Sequence
  Description of Artificial Sequence: Synthetic oligonucleotide
gggaggacgaugcgguagcuuguuccccgaugccccagacgacucgcccga

SEQ ID NO: 9499 - RNA, 51 nt, Artificial Sequence
  Description of Artificial Sequence: Synthetic oligonucleotide
gggaggacgaugcggcucaguuguguggcuugcgccagacgacucgcccga

SEQ ID NO: 9500 - RNA, 51 nt, Artificial Sequence
  Description of Artificial Sequence: Synthetic oligonucleotide
gggaggacgaugcggcauucguuugugcucguugccagacgacucgcccga

SEQ ID NO: 9501 - RNA, 51 nt, Artificial Sequence
  Description of Artificial Sequence: Synthetic oligonucleotide
gggaggacgaugcgguuggguguagggugggacugcagacgacucgcccga

SEQ ID NO: 9502 - RNA, 51 nt, Artificial Sequence
  Description of Artificial Sequence: Synthetic oligonucleotide
gggaggacgaugcggcgagcaauaacuacuguccccagacgacucgcccga

SEQ ID NO: 9503 - RNA, 51 nt, Artificial Sequence
  Description of Artificial Sequence: Synthetic oligonucleotide
gggaggacgaugcggauucggcacaccuuccucgccagacgacucgcccga

SEQ ID NO: 9504 - RNA, 51 nt, Artificial Sequence
  Description of Artificial Sequence: Synthetic oligonucleotide
gggaggacgaugcggacgagucugugacuucgcgccagacgacucgcccga

SEQ ID NO: 9505 - RNA, 51 nt, Artificial Sequence
  Description of Artificial Sequence: Synthetic oligonucleotide
gggaggacgaugcgguuugaaggguggugggucggcagacgacucgcccga

SEQ ID NO: 9506 - RNA, 51 nt, Artificial Sequence
  Description of Artificial Sequence: Synthetic oligonucleotide
gggaggacgaugcgguccugucgucuguucggccccagacgacucgcccga

SEQ ID NO: 9507 - RNA, 50 nt, Artificial Sequence
  Description of Artificial Sequence: Synthetic oligonucleotide
gggaggacgaugcgguccuggcuugucguugucccagacgacucgcccga

SEQ ID NO: 9508 - RNA, 51 nt, Artificial Sequence
  Description of Artificial Sequence: Synthetic oligonucleotide
gggaggacgaugcgguucuucccuugcacgugugccagacgacucgcccga

SEQ ID NO: 9509 - RNA, 51 nt, Artificial Sequence
  Description of Artificial Sequence: Synthetic oligonucleotide
gggaggacgaugcgguuugaagggugaugggccugcagacgacucgcccga

SEQ ID NO: 9510 - RNA, 50 nt, Artificial Sequence
  Description of Artificial Sequence: Synthetic oligonucleotide
gggaggacgaugcgguccuggcuuguguuguccccagacgacucgcccga

SEQ ID NO: 9511 - RNA, 51 nt, Artificial Sequence
  Description of Artificial Sequence: Synthetic oligonucleotide
gggaggacgaugcgguuggccaguagauguuacugcagacgacucgcccga

SEQ ID NO: 9512 - RNA, 49 nt, Artificial Sequence
  Description of Artificial Sequence: Synthetic oligonucleotide
gggaggacgaugcgguuugaagggugaugcccgcagacgacucgcccga

SEQ ID NO: 9513 - RNA, 51 nt, Artificial Sequence
  Description of Artificial Sequence: Synthetic oligonucleotide
gggaggacgaugcggccaauacgugauucuggccccagacgacucgcccga

SEQ ID NO: 9514 - RNA, 51 nt, Artificial Sequence
  Description of Artificial Sequence: Synthetic oligonucleotide
gggaggacgaugcggguacguaauuuacugugccccagacgacucgcccga

SEQ ID NO: 9515 - RNA, 51 nt, Artificial Sequence
  Description of Artificial Sequence: Synthetic oligonucleotide
gggaggacgaugcggguucaccaaugaccgaucugcagacgacucgcccga

SEQ ID NO: 9516 - RNA, 51 nt, Artificial Sequence
  Description of Artificial Sequence: Synthetic oligonucleotide
gggaggacgaugcgggugcuugucagguuuaccgccagacgacucgcccga

SEQ ID NO: 9517 - RNA, 52 nt, Artificial Sequence
  Description of Artificial Sequence: Synthetic oligonucleotide
gggaggacgaugcgguuugaagggugauggggggugcagacgacucgcccga

SEQ ID NO: 9518 - RNA, 51 nt, Artificial Sequence
  Description of Artificial Sequence: Synthetic oligonucleotide
gggaggacgaugcggaacaucacucccacuccccccagacgacucgcccga

SEQ ID NO: 9519 - RNA, 51 nt, Artificial Sequence
  Description of Artificial Sequence: Synthetic oligonucleotide
gggaggacgaugcgguauguugcgcuuucucuccccagacgacucgcccga

SEQ ID NO: 9520 - RNA, 51 nt, Artificial Sequence
  Description of Artificial Sequence: Synthetic oligonucleotide
gggaggacgaugcggucacgguauucugcgugccccagacgacucgcccga

SEQ ID NO: 9521 - RNA, 51 nt, Artificial Sequence
  Description of Artificial Sequence: Synthetic oligonucleotide
gggaggacgaugcggcauagucgucuuucagcccccagacgacucgcccga

SEQ ID NO: 9522 - RNA, 51 nt, Artificial Sequence
  Description of Artificial Sequence: Synthetic oligonucleotide
gggaggacgaugcggcccuucguccuacgucugugcagacgacucgcccga

SEQ ID NO: 9523 - RNA, 51 nt, Artificial Sequence
  Description of Artificial Sequence: Synthetic oligonucleotide
gggaggacgaugcgggauugggcugauccugugugcagacgacucgcccga

SEQ ID NO: 9524 - RNA, 51 nt, Artificial Sequence
  Description of Artificial Sequence: Synthetic oligonucleotide
gggaggacgaugcggucucguuacucccguccccccagacgacucgcccga

SEQ ID NO: 9525 - RNA, 51 nt, Artificial Sequence
  Description of Artificial Sequence: Synthetic oligonucleotide
gggaggacgaugcggcguagucaucgacacguguacagacgacucgcccga

SEQ ID NO: 9526 - RNA, 51 nt, Artificial Sequence
  Description of Artificial Sequence: Synthetic oligonucleotide
gggaggacgaugcggagaagucuguauugcguggccagacgacucgcccga

SEQ ID NO: 9527 - RNA, 51 nt, Artificial Sequence
  Description of Artificial Sequence: Synthetic oligonucleotide
gggaggacgaugcggaaauggcuuacugugugcugcagacgacucgcccga

SEQ ID NO: 9528 - RNA, 51 nt, Artificial Sequence
  Description of Artificial Sequence: Synthetic oligonucleotide
gggaggacgaugcgguaggucgcugcaugacugugcagacgacucgcccga

SEQ ID NO: 9529 - RNA, 51 nt, Artificial Sequence
  Description of Artificial Sequence: Synthetic oligonucleotide
gggaggacgaugcgguuugggguuucccccugccccagacgacucgcccga

SEQ ID NO: 9530 - RNA, 49 nt, Artificial Sequence
  Description of Artificial Sequence: Synthetic oligonucleotide
gggaggacgaugcggugcguugcguuugguuugcagacgacucgcccga

SEQ ID NO: 9531 - RNA, 51 nt, Artificial Sequence
  Description of Artificial Sequence: Synthetic oligonucleotide
gggaggacgaugcggguugaagggugagggguccgcagacgacucgcccga

SEQ ID NO: 9532 - RNA, 51 nt, Artificial Sequence
  Description of Artificial Sequence: Synthetic oligonucleotide
gggaggacgaugcggugguuacucucuacgcuccgcagacgacucgcccga

SEQ ID NO: 9533 - RNA, 51 nt, Artificial Sequence
  Description of Artificial Sequence: Synthetic oligonucleotide
gggaggacgaugcgggucauuguuuuugucgugugcagacgacucgcccga

SEQ ID NO: 9534 - RNA, 51 nt, Artificial Sequence
  Description of Artificial Sequence: Synthetic oligonucleotide
gggaggacgaugcggaaucuaccuuccugucgugccagacgacucgcccga

SEQ ID NO: 9535 - RNA, 51 nt, Artificial Sequence
  Description of Artificial Sequence: Synthetic oligonucleotide
gggaggacgaugcggucuuccaaacgguccgugugcagacgacucgcccga

SEQ ID NO: 9536 - RNA, 51 nt, Artificial Sequence
  Description of Artificial Sequence: Synthetic oligonucleotide
gggaggacgaugcggauuggagggggaugggacugcagacgacucgcccga

SEQ ID NO: 9537 - RNA, 51 nt, Artificial Sequence
  Description of Artificial Sequence: Synthetic oligonucleotide
gggaggacgaugcgggccuugcguucugaccuccccagacgacucgcccga

SEQ ID NO: 9538 - RNA, 51 nt, Artificial Sequence
  Description of Artificial Sequence: Synthetic oligonucleotide
gggaggacgaugcggucgaucguaaugucuggccccagacgacucgcccga

SEQ ID NO: 9539 - RNA, 51 nt, Artificial Sequence
  Description of Artificial Sequence: Synthetic oligonucleotide
gggaggacgaugcggcuagucgaaccgaugcuguccagacgacucgcccga

SEQ ID NO: 9540 - RNA, 51 nt, Artificial Sequence
  Description of Artificial Sequence: Synthetic oligonucleotide
gggaggacgaugcggaugagguaaggaccaccgugcagacgacucgcccga

SEQ ID NO: 9541 - RNA, 51 nt, Artificial Sequence
  Description of Artificial Sequence: Synthetic oligonucleotide
gggaggacgaugcggucgaugucuuccacguggcccagacgacucgcccga

SEQ ID NO: 9542 - RNA, 51 nt, Artificial Sequence
  Description of Artificial Sequence: Synthetic oligonucleotide
gggaggacgaugcggauugcucaggcugugguggccagacgacucgcccga

SEQ ID NO: 9543 - RNA, 51 nt, Artificial Sequence
  Description of Artificial Sequence: Synthetic oligonucleotide
gggaggacgaugcgguuugucgggugauggguccgcagacgacucgcccga

SEQ ID NO: 9544 - RNA, 51 nt, Artificial Sequence
  Description of Artificial Sequence: Synthetic oligonucleotide
gggaggacgaugcgguuugaagggcgacggguccgcagacgacucgcccga

SEQ ID NO: 9545 - RNA, 51 nt, Artificial Sequence
  Description of Artificial Sequence: Synthetic oligonucleotide
gggaggacgaugcgguuugaagggugauauguccgcagacgacucgcccga

SEQ ID NO: 9546 - RNA, 51 nt, Artificial Sequence
  Description of Artificial Sequence: Synthetic oligonucleotide
gggaggacgaugcgguauacggcgguggggggauacagacgacucgcccga

SEQ ID NO: 9547 - RNA, 51 nt, Artificial Sequence
  Description of Artificial Sequence: Synthetic oligonucleotide
gggaggacgaugcggucuugucgucucuucguccccagacgacucgcccga

SEQ ID NO: 9548 - RNA, 51 nt, Artificial Sequence
  Description of Artificial Sequence: Synthetic oligonucleotide
gggaggacgaugcgguuugaagggggauagguccgcagacgacucgcccga

SEQ ID NO: 9549 - RNA, 51 nt, Artificial Sequence
  Description of Artificial Sequence: Synthetic oligonucleotide
gggaggacgaugcggauuccacauugucgcguccccagacgacucgcccga

SEQ ID NO: 9550 - RNA, 51 nt, Artificial Sequence
  Description of Artificial Sequence: Synthetic oligonucleotide
gggaggacgaugcggauaucgccuccuaacgugcccagacgacucgcccga

SEQ ID NO: 9551 - RNA, 51 nt, Artificial Sequence
  Description of Artificial Sequence: Synthetic oligonucleotide
gggaggacgaugcgguuugaagggcgaugggucugcagacgacucgcccga

SEQ ID NO: 9552 - RNA, 51 nt, Artificial Sequence
  Description of Artificial Sequence: Synthetic oligonucleotide
gggaggacgaugcggacaaaucggcuggcgugcaccagacgacucgcccga

SEQ ID NO: 9553 - RNA, 51 nt, Artificial Sequence
  Description of Artificial Sequence: Synthetic oligonucleotide
gggaggacgaugcgggacgcuacacgggguuugugcagacgacucgcccga

SEQ ID NO: 9554 - RNA, 51 nt, Artificial Sequence
  Description of Artificial Sequence: Synthetic oligonucleotide
gggaggacgaugcgguuugaggggugaugggaccgcagacgacucgcccga

SEQ ID NO: 9555 - RNA, 51 nt, Artificial Sequence
  Description of Artificial Sequence: Synthetic oligonucleotide
gggaggacgaugcgguaccgcaccucuacgauccgcagacgacucgcccga

SEQ ID NO: 9556 - RNA, 49 nt, Artificial Sequence
  Description of Artificial Sequence: Synthetic oligonucleotide
gggaggacgaugcggcgucgagcuuccugucugcagacgacucgcccga

SEQ ID NO: 9557 - RNA, 51 nt, Artificial Sequence
  Description of Artificial Sequence: Synthetic oligonucleotide
gggaggacgaugcgggaugacguugucguggccuccagacgacucgcccga

SEQ ID NO: 9558 - RNA, 51 nt, Artificial Sequence
  Description of Artificial Sequence: Synthetic oligonucleotide
gggaggacgaugcggaaccaguaauacccgcuccccagacgacucgcccga

SEQ ID NO: 9559 - RNA, 50 nt, Artificial Sequence
  Description of Artificial Sequence: Synthetic oligonucleotide
gggaggacgaugcggauuggugaagggaggguugcagacgacucgcccga

SEQ ID NO: 9560 - RNA, 51 nt, Artificial Sequence
  Description of Artificial Sequence: Synthetic oligonucleotide
gggaggacgaugcggcaucgcacuguuacuguccccagacgacucgcccga

SEQ ID NO: 9561 - RNA, 51 nt, Artificial Sequence
  Description of Artificial Sequence: Synthetic oligonucleotide
gggaggacgaugcgguuugaagggugaugggucuccagacgacucgcccga

SEQ ID NO: 9562 - RNA, 51 nt, Artificial Sequence
  Description of Artificial Sequence: Synthetic oligonucleotide
gggaggacgaugcgguccucaacgauucgcugcgucagacgacucgcccga

SEQ ID NO: 9563 - RNA, 51 nt, Artificial Sequence
  Description of Artificial Sequence: Synthetic oligonucleotide
gggaggacgaugcggacauaccgaucucccguccccagacgacucgcccga

SEQ ID NO: 9564 - RNA, 51 nt, Artificial Sequence
  Description of Artificial Sequence: Synthetic oligonucleotide
gggaggacgaugcggauucggcuuccugugugcaccagacgacucgcccga

SEQ ID NO: 9565 - RNA, 51 nt, Artificial Sequence
  Description of Artificial Sequence: Synthetic oligonucleotide
gggaggacgaugcgguaucggugucccacggucgccagacgacucgcccga

SEQ ID NO: 9566 - RNA, 51 nt, Artificial Sequence
  Description of Artificial Sequence: Synthetic oligonucleotide
gggaggacgaugcggguacuacuuggcaugcggaccagacgacucgcccga

SEQ ID NO: 9567 - RNA, 51 nt, Artificial Sequence
  Description of Artificial Sequence: Synthetic oligonucleotide
gggaggacgaugcggccuuugucuggugccguuaccagacgacucgcccga

SEQ ID NO: 9568 - RNA, 51 nt, Artificial Sequence
  Description of Artificial Sequence: Synthetic oligonucleotide
gggaggacgaugcgggaauucgcuuggcuaguggccagacgacucgcccga

SEQ ID NO: 9569 - RNA, 51 nt, Artificial Sequence
  Description of Artificial Sequence: Synthetic oligonucleotide
gggaggacgaugcgguuugaaggggggugggucugcagacgacucgcccga

SEQ ID NO: 9570 - RNA, 51 nt, Artificial Sequence
  Description of Artificial Sequence: Synthetic oligonucleotide
gggaggacgaugcggagaguuguaacuguggugugcagacgacucgcccga

SEQ ID NO: 9571 - RNA, 51 nt, Artificial Sequence
  Description of Artificial Sequence: Synthetic oligonucleotide
gggaggacgaugcgguucgcaaugccuuuccgccccagacgacucgcccga

SEQ ID NO: 9572 - RNA, 51 nt, Artificial Sequence
  Description of Artificial Sequence: Synthetic oligonucleotide
gggaggacgaugcggugaguucuaucuguuggccccagacgacucgcccga

SEQ ID NO: 9573 - RNA, 51 nt, Artificial Sequence
  Description of Artificial Sequence: Synthetic oligonucleotide
gggaggacgaugcggguugaagggugaugggaccgcagacgacucgcccga

SEQ ID NO: 9574 - RNA, 51 nt, Artificial Sequence
  Description of Artificial Sequence: Synthetic oligonucleotide
gggaggacgaugcggucuaggguccuccguugcugcagacgacucgcccga

SEQ ID NO: 9575 - RNA, 51 nt, Artificial Sequence
  Description of Artificial Sequence: Synthetic oligonucleotide
gggaggacgaugcggcaaauaccuuccacccgcugcagacgacucgcccga

SEQ ID NO: 9576 - RNA, 51 nt, Artificial Sequence
  Description of Artificial Sequence: Synthetic oligonucleotide
gggaggacgaugcggccgucucuugacgugcuccccagacgacucgcccga

SEQ ID NO: 9577 - RNA, 51 nt, Artificial Sequence
  Description of Artificial Sequence: Synthetic oligonucleotide
gggaggacgaugcgguuggguguauggagguaccgcagacgacucgcccga

SEQ ID NO: 9578 - RNA, 51 nt, Artificial Sequence
  Description of Artificial Sequence: Synthetic oligonucleotide
gggaggacgaugcggugguggaguuugucugugugcagacgacucgcccga

SEQ ID NO: 9579 - RNA, 51 nt, Artificial Sequence
  Description of Artificial Sequence: Synthetic oligonucleotide
gggaggacgaugcgguuugaggggugauggggccgcagacgacucgcccga

SEQ ID NO: 9580 - RNA, 51 nt, Artificial Sequence
  Description of Artificial Sequence: Synthetic oligonucleotide
gggaggacgaugcggguugaaggguguuggguccgcagacgacucgcccga

SEQ ID NO: 9581 - RNA, 51 nt, Artificial Sequence
  Description of Artificial Sequence: Synthetic oligonucleotide
gggaggacgaugcgguuggguggagggagguaccgcagacgacucgcccga

SEQ ID NO: 9582 - RNA, 50 nt, Artificial Sequence
  Description of Artificial Sequence: Synthetic oligonucleotide
gggaggacgaugcggcugaagggugauggguccgcagacgacucgcccga

SEQ ID NO: 9583 - RNA, 51 nt, Artificial Sequence
  Description of Artificial Sequence: Synthetic oligonucleotide
gggaggacgaugcgguuuggaggaugaugggaccgcagacgacucgcccga

SEQ ID NO: 9584 - RNA, 51 nt, Artificial Sequence
  Description of Artificial Sequence: Synthetic oligonucleotide
gggaggacgaugcgguuugguguaggguguuaccgcagacgacucgcccga

SEQ ID NO: 9585 - RNA, 50 nt, Artificial Sequence
  Description of Artificial Sequence: Synthetic oligonucleotide
gggaggacgaugcggauugggaagggagguaccgcagacgacucgcccga

SEQ ID NO: 9586 - RNA, 51 nt, Artificial Sequence
  Description of Artificial Sequence: Synthetic oligonucleotide
gggaggacgaugcggacgguugcuuuggcguuggccagacgacucgcccga

SEQ ID NO: 9587 - RNA, 51 nt, Artificial Sequence
  Description of Artificial Sequence: Synthetic oligonucleotide
gggaggacgaugcggccgcaaccuuaauccugccccagacgacucgcccga

SEQ ID NO: 9588 - RNA, 49 nt, Artificial Sequence
  Description of Artificial Sequence: Synthetic oligonucleotide
gggaggacgaugcgguuuugggugauggguccgcagacgacucgcccga

SEQ ID NO: 9589 - RNA, 51 nt, Artificial Sequence
  Description of Artificial Sequence: Synthetic oligonucleotide
gggaggacgaugcggcuugaaaggugauggguccgcagacgacucgcccga

SEQ ID NO: 9590 - RNA, 50 nt, Artificial Sequence
  Description of Artificial Sequence: Synthetic oligonucleotide
gggaggacgaugcgggggguguagggugguaccgcagacgacucgcccga

SEQ ID NO: 9591 - RNA, 51 nt, Artificial Sequence
  Description of Artificial Sequence: Synthetic oligonucleotide
gggaggacgaugcgguuuggaggggggagggaccgcagacgacucgcccga

SEQ ID NO: 9592 - RNA, 51 nt, Artificial Sequence
  Description of Artificial Sequence: Synthetic oligonucleotide
gggaggacgaugcggaauuggagguguagggaccgcagacgacucgcccga

SEQ ID NO: 9593 - RNA, 51 nt, Artificial Sequence
  Description of Artificial Sequence: Synthetic oligonucleotide
gggaggacgaugcgguauuagagguguagggaccgcagacgacucgcccga

SEQ ID NO: 9594 - RNA, 51 nt, Artificial Sequence
  Description of Artificial Sequence: Synthetic oligonucleotide
gggaggacgaugcgguuugaagggugaugggcccccagacgacucgcccga

SEQ ID NO: 9595 - RNA, 51 nt, Artificial Sequence
  Description of Artificial Sequence: Synthetic oligonucleotide
gggaggacgaugcgggucuucuggcuuaucguccacagacgacucgcccga

SEQ ID NO: 9596 - RNA, 51 nt, Artificial Sequence
  Description of Artificial Sequence: Synthetic oligonucleotide
gggaggacgaugcggucuuccguaauagcgcugcccagacgacucgcccga

SEQ ID NO: 9597 - RNA, 51 nt, Artificial Sequence
  Description of Artificial Sequence: Synthetic oligonucleotide
gggaggacgaugcgggccuucguuacucugcacugcagacgacucgcccga

SEQ ID NO: 9598 - RNA, 51 nt, Artificial Sequence
  Description of Artificial Sequence: Synthetic oligonucleotide
gggaggacgaugcggcuaaguguccugccggucugcagacgacucgcccga

SEQ ID NO: 9599 - RNA, 51 nt, Artificial Sequence
  Description of Artificial Sequence: Synthetic oligonucleotide
gggaggacgaugcggacccucaugaucuuggccugcagacgacucgcccga

SEQ ID NO: 9600 - RNA, 51 nt, Artificial Sequence
  Description of Artificial Sequence: Synthetic oligonucleotide
gggaggacgaugcgguucaccuucugaucgugccccagacgacucgcccga

SEQ ID NO: 9601 - RNA, 51 nt, Artificial Sequence
  Description of Artificial Sequence: Synthetic oligonucleotide
gggaggacgaugcggaugagucgaguugggggcugcagacgacucgcccga

SEQ ID NO: 9602 - RNA, 51 nt, Artificial Sequence
  Description of Artificial Sequence: Synthetic oligonucleotide
gggaggacgaugcgguuuguucccccaauugugcccagacgacucgcccga

SEQ ID NO: 9603 - RNA, 51 nt, Artificial Sequence
  Description of Artificial Sequence: Synthetic oligonucleotide
gggaggacgaugcggugauugucugcuggcuugcccagacgacucgcccga

SEQ ID NO: 9604 - RNA, 51 nt, Artificial Sequence
  Description of Artificial Sequence: Synthetic oligonucleotide
gggaggacgaugcggugcgaucacaguacggcgugcagacgacucgcccga

SEQ ID NO: 9605 - RNA, 51 nt, Artificial Sequence
  Description of Artificial Sequence: Synthetic oligonucleotide
gggaggacgaugcgguaucuuccgucgccugucaccagacgacucgcccga

SEQ ID NO: 9606 - RNA, 51 nt, Artificial Sequence
  Description of Artificial Sequence: Synthetic oligonucleotide
gggaggacgaugcggauuggugaagggggggacugcagacgacucgcccga

SEQ ID NO: 9607 - RNA, 51 nt, Artificial Sequence
  Description of Artificial Sequence: Synthetic oligonucleotide
gggaggacgaugcggauguccuacccgucguuggccagacgacucgcccga

SEQ ID NO: 9608 - RNA, 52 nt, Artificial Sequence
  Description of Artificial Sequence: Synthetic oligonucleotide
gggaggacgaugcggucgcauucauccccaugcccccagacgacucgcccga

SEQ ID NO: 9609 - RNA, 51 nt, Artificial Sequence
  Description of Artificial Sequence: Synthetic oligonucleotide
gggaggacgaugcggucuuccuuguguguucgcgccagacgacucgcccga

SEQ ID NO: 9610 - RNA, 51 nt, Artificial Sequence
  Description of Artificial Sequence: Synthetic oligonucleotide
gggaggacgaugcgguauagugacauguguugcgucagacgacucgcccga

SEQ ID NO: 9611 - RNA, 51 nt, Artificial Sequence
  Description of Artificial Sequence: Synthetic oligonucleotide
gggaggacgaugcgguuaguccuggucucguuggccagacgacucgcccga

SEQ ID NO: 9612 - RNA, 51 nt, Artificial Sequence
  Description of Artificial Sequence: Synthetic oligonucleotide
gggaggacgaugcgguacagcugaccccgugucaccagacgacucgcccga

SEQ ID NO: 9613 - RNA, 50 nt, Artificial Sequence
  Description of Artificial Sequence: Synthetic oligonucleotide
gggaggacgaugcggugcguuucgucucgcgucccagacgacucgcccga

SEQ ID NO: 9614 - RNA, 51 nt, Artificial Sequence
  Description of Artificial Sequence: Synthetic oligonucleotide
gggaggacgaugcgguuugguggagggugggacugcagacgacucgcccga

SEQ ID NO: 9615 - RNA, 51 nt, Artificial Sequence
  Description of Artificial Sequence: Synthetic oligonucleotide
gggaggacgaugcggccuaggagaaugaguugcaccagacgacucgcccga

SEQ ID NO: 9616 - RNA, 51 nt, Artificial Sequence
  Description of Artificial Sequence: Synthetic oligonucleotide
gggaggacgaugcggguagcguuauggugcagugccagacgacucgcccga

SEQ ID NO: 9617 - RNA, 50 nt, Artificial Sequence
  Description of Artificial Sequence: Synthetic oligonucleotide
gggaggacgaugcgguccugucgucuguucgccccagacgacucgcccga

SEQ ID NO: 9618 - RNA, 51 nt, Artificial Sequence
  Description of Artificial Sequence: Synthetic oligonucleotide
gggaggacgaugcggugucguagaugguugccggccagacgacucgcccga

SEQ ID NO: 9619 - RNA, 51 nt, Artificial Sequence
  Description of Artificial Sequence: Synthetic oligonucleotide
gggaggacgaugcggcuuuauacuguaagcaacggcagacgacucgcccga

SEQ ID NO: 9620 - RNA, 51 nt, Artificial Sequence
  Description of Artificial Sequence: Synthetic oligonucleotide
gggaggacgaugcggaccauaccuucuugcccccccagacgacucgcccga

SEQ ID NO: 9621 - RNA, 51 nt, Artificial Sequence
  Description of Artificial Sequence: Synthetic oligonucleotide
gggaggacgaugcggccugcaacuuuucgcugcugcagacgacucgcccga

SEQ ID NO: 9622 - RNA, 51 nt, Artificial Sequence
  Description of Artificial Sequence: Synthetic oligonucleotide
gggaggacgaugcgguaggggcaaucgucuauggccagacgacucgcccga

SEQ ID NO: 9623 - RNA, 51 nt, Artificial Sequence
  Description of Artificial Sequence: Synthetic oligonucleotide
gggaggacgaugcggaccgcuuaauaauccugccccagacgacucgcccga

SEQ ID NO: 9624 - RNA, 51 nt, Artificial Sequence
  Description of Artificial Sequence: Synthetic oligonucleotide
gggaggacgaugcgguccuaaaaucguuaccugcccagacgacucgcccga

SEQ ID NO: 9625 - RNA, 51 nt, Artificial Sequence
  Description of Artificial Sequence: Synthetic oligonucleotide
gggaggacgaugcggcacgucuucuccguuugcgccagacgacucgcccga

SEQ ID NO: 9626 - RNA, 51 nt, Artificial Sequence
  Description of Artificial Sequence: Synthetic oligonucleotide
gggaggacgaugcggauagggagaaaggugaaccgcagacgacucgcccga

SEQ ID NO: 9627 - RNA, 51 nt, Artificial Sequence
  Description of Artificial Sequence: Synthetic oligonucleotide
gggaggacgaugcggguaaguugucagccucucgccagacgacucgcccga

SEQ ID NO: 9628 - RNA, 51 nt, Artificial Sequence
  Description of Artificial Sequence: Synthetic oligonucleotide
gggaggacgaugcgguuugaguggugauggguccgcagacgacucgcccga

SEQ ID NO: 9629 - RNA, 50 nt, Artificial Sequence
  Description of Artificial Sequence: Synthetic oligonucleotide
gggaggacgaugcggugugcuuuaugccuggccccagacgacucgcccga

SEQ ID NO: 9630 - RNA, 51 nt, Artificial Sequence
  Description of Artificial Sequence: Synthetic oligonucleotide
gggaggacgaugcggguuuucuggcuuaucguccccagacgacucgcccga

SEQ ID NO: 9631 - RNA, 51 nt, Artificial Sequence
  Description of Artificial Sequence: Synthetic oligonucleotide
gggaggacgaugcggggaugauguuaguuuggcgccagacgacucgcccga

SEQ ID NO: 9632 - RNA, 51 nt, Artificial Sequence
  Description of Artificial Sequence: Synthetic oligonucleotide
gggaggacgaugcggguaagacguccacauacgugcagacgacucgcccga

SEQ ID NO: 9633 - RNA, 51 nt, Artificial Sequence
  Description of Artificial Sequence: Synthetic oligonucleotide
gggaggacgaugcggcguuuccucugguucguccucagacgacucgcccga

SEQ ID NO: 9634 - RNA, 51 nt, Artificial Sequence
  Description of Artificial Sequence: Synthetic oligonucleotide
gggaggacgaugcggaauccucaaaagugcguguacagacgacucgcccga

SEQ ID NO: 9635 - RNA, 51 nt, Artificial Sequence
  Description of Artificial Sequence: Synthetic oligonucleotide
gggaggacgaugcggauacugagucguaaguugugcagacgacucgcccga

SEQ ID NO: 9636 - RNA, 51 nt, Artificial Sequence
  Description of Artificial Sequence: Synthetic oligonucleotide
gggaggacgaugcggucggcucgucucgugauccccagacgacucgcccga

SEQ ID NO: 9637 - RNA, 50 nt, Artificial Sequence
  Description of Artificial Sequence: Synthetic oligonucleotide
gggaggacgaugcgguugaagggugauggguccccagacgacucgcccga

SEQ ID NO: 9638 - RNA, 51 nt, Artificial Sequence
  Description of Artificial Sequence: Synthetic oligonucleotide
gggaggacgaugcgguggcguuuugagcggcugugcagacgacucgcccga

SEQ ID NO: 9639 - RNA, 51 nt, Artificial Sequence
  Description of Artificial Sequence: Synthetic oligonucleotide
gggaggacgaugcgguuugaaggguguugggcccgcagacgacucgcccga

SEQ ID NO: 9640 - RNA, 51 nt, Artificial Sequence
  Description of Artificial Sequence: Synthetic oligonucleotide
gggaggacgaugcggcacuuucguucugaccuccccagacgacucgcccga

SEQ ID NO: 9641 - RNA, 51 nt, Artificial Sequence
  Description of Artificial Sequence: Synthetic oligonucleotide
gggaggacgaugcgguccucaguguuauggugcgccagacgacucgcccga

SEQ ID NO: 9642 - RNA, 51 nt, Artificial Sequence
  Description of Artificial Sequence: Synthetic oligonucleotide
gggaggacgaugcgguuguauguacgacggugcugcagacgacucgcccga

SEQ ID NO: 9643 - RNA, 51 nt, Artificial Sequence
  Description of Artificial Sequence: Synthetic oligonucleotide
gggaggacgaugcgggcuaagacacucaugugccgcagacgacucgcccga

SEQ ID NO: 9644 - RNA, 51 nt, Artificial Sequence
  Description of Artificial Sequence: Synthetic oligonucleotide
gggaggacgaugcggugguuugacugucugugccccagacgacucgcccga

SEQ ID NO: 9645 - RNA, 51 nt, Artificial Sequence
  Description of Artificial Sequence: Synthetic oligonucleotide
gggaggacgaugcggucuguccucugugcacuccccagacgacucgcccga

SEQ ID NO: 9646 - RNA, 51 nt, Artificial Sequence
  Description of Artificial Sequence: Synthetic oligonucleotide
gggaggacgaugcgggaucaacuggaacacguggccagacgacucgcccga

SEQ ID NO: 9647 - RNA, 51 nt, Artificial Sequence
  Description of Artificial Sequence: Synthetic oligonucleotide
gggaggacgaugcgguaugaaggaagugcccacugcagacgacucgcccga

SEQ ID NO: 9648 - RNA, 51 nt, Artificial Sequence
  Description of Artificial Sequence: Synthetic oligonucleotide
gggaggacgaugcgguuuugguccauccugcugcccagacgacucgcccga

SEQ ID NO: 9649 - RNA, 51 nt, Artificial Sequence
  Description of Artificial Sequence: Synthetic oligonucleotide
gggaggacgaugcgguccuugucgucuuacguccccagacgacucgcccga

SEQ ID NO: 9650 - RNA, 51 nt, Artificial Sequence
  Description of Artificial Sequence: Synthetic oligonucleotide
gggaggacgaugcggucgucaacaaaaugugacgccagacgacucgcccga

SEQ ID NO: 9651 - RNA, 51 nt, Artificial Sequence
  Description of Artificial Sequence: Synthetic oligonucleotide
gggaggacgaugcgguucccgcuaaccaguacccccagacgacucgcccga

SEQ ID NO: 9652 - RNA, 51 nt, Artificial Sequence
  Description of Artificial Sequence: Synthetic oligonucleotide
gggaggacgaugcggugcuggugguuucgcggcugcagacgacucgcccga

SEQ ID NO: 9653 - RNA, 51 nt, Artificial Sequence
  Description of Artificial Sequence: Synthetic oligonucleotide
gggaggacgaugcgggucuacgucgucagcugcaccagacgacucgcccga

SEQ ID NO: 9654 - RNA, 51 nt, Artificial Sequence
  Description of Artificial Sequence: Synthetic oligonucleotide
gggaggacgaugcgguuccugucgucgauuugcgccagacgacucgcccga

SEQ ID NO: 9655 - RNA, 51 nt, Artificial Sequence
  Description of Artificial Sequence: Synthetic oligonucleotide
gggaggacgaugcgggaugaguaucaggccugcgccagacgacucgcccga

SEQ ID NO: 9656 - RNA, 51 nt, Artificial Sequence
  Description of Artificial Sequence: Synthetic oligonucleotide
gggaggacgaugcggucuauagucauaucggugcccagacgacucgcccga

SEQ ID NO: 9657 - RNA, 51 nt, Artificial Sequence
  Description of Artificial Sequence: Synthetic oligonucleotide
gggaggacgaugcggagcuggacacuuggggucugcagacgacucgcccga

SEQ ID NO: 9658 - RNA, 51 nt, Artificial Sequence
  Description of Artificial Sequence: Synthetic oligonucleotide
gggaggacgaugcgguccgcguugcucucgcacaccagacgacucgcccga

SEQ ID NO: 9659 - RNA, 51 nt, Artificial Sequence
  Description of Artificial Sequence: Synthetic oligonucleotide
gggaggacgaugcggguuguccuuugcuuccgcaccagacgacucgcccga

SEQ ID NO: 9660 - RNA, 51 nt, Artificial Sequence
  Description of Artificial Sequence: Synthetic oligonucleotide
gggaggacgaugcggaaaucgucauuuaguguguccagacgacucgcccga

SEQ ID NO: 9661 - RNA, 51 nt, Artificial Sequence
  Description of Artificial Sequence: Synthetic oligonucleotide
gggaggacgaugcggcagaggagaagggagguucccagacgacucgcccga

SEQ ID NO: 9662 - RNA, 51 nt, Artificial Sequence
  Description of Artificial Sequence: Synthetic oligonucleotide
gggaggacgaugcggucguguucguuuugcaugugcagacgacucgcccga

SEQ ID NO: 9663 - RNA, 51 nt, Artificial Sequence
  Description of Artificial Sequence: Synthetic oligonucleotide
gggaggacgaugcgguuugaagggagauggcuccgcagacgacucgcccga

SEQ ID NO: 9664 - RNA, 51 nt, Artificial Sequence
  Description of Artificial Sequence: Synthetic oligonucleotide
gggaggacgaugcggcgacaagucuguacccuccccagacgacucgcccga

SEQ ID NO: 9665 - RNA, 51 nt, Artificial Sequence
  Description of Artificial Sequence: Synthetic oligonucleotide
gggaggacgaugcgguuugaaaggcgauggguccgcagacgacucgcccga

SEQ ID NO: 9666 - RNA, 51 nt, Artificial Sequence
  Description of Artificial Sequence: Synthetic oligonucleotide
gggaggacgaugcgguuuguaggguguuggguccgcagacgacucgcccga

SEQ ID NO: 9667 - RNA, 51 nt, Artificial Sequence
  Description of Artificial Sequence: Synthetic oligonucleotide
gggaggacgaugcgguuugacgggugguggguccgcagacgacucgcccga

SEQ ID NO: 9668 - RNA, 51 nt, Artificial Sequence
  Description of Artificial Sequence: Synthetic oligonucleotide
gggaggacgaugcggagaguuaaucugucuguggccagacgacucgcccga

SEQ ID NO: 9669 - RNA, 51 nt, Artificial Sequence
  Description of Artificial Sequence: Synthetic oligonucleotide
gggaggacgaugcgguauuggaaguguagggaccgcagacgacucgcccga

SEQ ID NO: 9670 - RNA, 49 nt, Artificial Sequence
  Description of Artificial Sequence: Synthetic oligonucleotide
gggaggacgaugcggauuggaagggagguacugcagacgacucgcccga

SEQ ID NO: 9671 - RNA, 51 nt, Artificial Sequence
  Description of Artificial Sequence: Synthetic oligonucleotide
gggaggacgaugcggccguccauguuacaccucuccagacgacucgcccga

SEQ ID NO: 9672 - RNA, 51 nt, Artificial Sequence
  Description of Artificial Sequence: Synthetic oligonucleotide
gggaggacgaugcgguuggggguauggugguaccgcagacgacucgcccga

SEQ ID NO: 9673 - RNA, 51 nt, Artificial Sequence
  Description of Artificial Sequence: Synthetic oligonucleotide
gggaggacgaugcggcacacgcguuaugucuaccccagacgacucgcccga

SEQ ID NO: 9674 - RNA, 51 nt, Artificial Sequence
  Description of Artificial Sequence: Synthetic oligonucleotide
gggaggacgaugcggccguaauagucccugauccccagacgacucgcccga

SEQ ID NO: 9675 - RNA, 51 nt, Artificial Sequence
  Description of Artificial Sequence: Synthetic oligonucleotide
gggaggacgaugcggaucaucaggcuguauaccgccagacgacucgcccga

SEQ ID NO: 9676 - RNA, 51 nt, Artificial Sequence
  Description of Artificial Sequence: Synthetic oligonucleotide
gggaggacgaugcgguugucuaccuucuacugccgcagacgacucgcccga

SEQ ID NO: 9677 - RNA, 51 nt, Artificial Sequence
  Description of Artificial Sequence: Synthetic oligonucleotide
gggaggacgaugcggucugaagggagauggguccgcagacgacucgcccga

SEQ ID NO: 9678 - RNA, 51 nt, Artificial Sequence
  Description of Artificial Sequence: Synthetic oligonucleotide
gggaggacgaugcggacacuacaaaauggucgcugcagacgacucgcccga

SEQ ID NO: 9679 - RNA, 51 nt, Artificial Sequence
  Description of Artificial Sequence: Synthetic oligonucleotide
gggaggacgaugcgggacggaggugucgucgugugcagacgacucgcccga

SEQ ID NO: 9680 - RNA, 51 nt, Artificial Sequence
  Description of Artificial Sequence: Synthetic oligonucleotide
gggaggacgaugcggauugaagggugguggguccgcagacgacucgcccga

SEQ ID NO: 9681 - RNA, 51 nt, Artificial Sequence
  Description of Artificial Sequence: Synthetic oligonucleotide
gggaggacgaugcgggauuggagguguagggaccgcagacgacucgcccga

SEQ ID NO: 9682 - RNA, 51 nt, Artificial Sequence
  Description of Artificial Sequence: Synthetic oligonucleotide
gggaggacgaugcggaccccaauguagucuguggccagacgacucgcccga

SEQ ID NO: 9683 - RNA, 51 nt, Artificial Sequence
  Description of Artificial Sequence: Synthetic oligonucleotide
gggaggacgaugcggagucgucuuucgagccugaccagacgacucgcccga

SEQ ID NO: 9684 - RNA, 51 nt, Artificial Sequence
  Description of Artificial Sequence: Synthetic oligonucleotide
gggaggacgaugcggauugugaauggagccggcugcagacgacucgcccga

SEQ ID NO: 9685 - RNA, 51 nt, Artificial Sequence
  Description of Artificial Sequence: Synthetic oligonucleotide
gggaggacgaugcggcaguccugucgucguguagccagacgacucgcccga

SEQ ID NO: 9686 - RNA, 51 nt, Artificial Sequence
  Description of Artificial Sequence: Synthetic oligonucleotide
gggaggacgaugcgguuugaagggggaugaguccgcagacgacucgcccga

SEQ ID NO: 9687 - RNA, 51 nt, Artificial Sequence
  Description of Artificial Sequence: Synthetic oligonucleotide
gggaggacgaugcgggaugaguccaaccccgugugcagacgacucgcccga

SEQ ID NO: 9688 - RNA, 51 nt, Artificial Sequence
  Description of Artificial Sequence: Synthetic oligonucleotide
gggaggacgaugcgguuugauggggggugggaccgcagacgacucgcccga

SEQ ID NO: 9689 - RNA, 51 nt, Artificial Sequence
  Description of Artificial Sequence: Synthetic oligonucleotide
gggaggacgaugcgggugcucuugucucucgugugcagacgacucgcccga

SEQ ID NO: 9690 - RNA, 50 nt, Artificial Sequence
  Description of Artificial Sequence: Synthetic oligonucleotide
gggaggacgaugcggucgaagggugauggguccgcagacgacucgcccga

SEQ ID NO: 9691 - RNA, 51 nt, Artificial Sequence
  Description of Artificial Sequence: Synthetic oligonucleotide
gggaggacgaugcggauuugcguucucucgagccgcagacgacucgcccga

SEQ ID NO: 9692 - RNA, 51 nt, Artificial Sequence
  Description of Artificial Sequence: Synthetic oligonucleotide
gggaggacgaugcggacacuggagaaccugugccccagacgacucgcccga

SEQ ID NO: 9693 - RNA, 51 nt, Artificial Sequence
  Description of Artificial Sequence: Synthetic oligonucleotide
gggaggacgaugcgguucgauugguccccaguccgcagacgacucgcccga

SEQ ID NO: 9694 - RNA, 51 nt, Artificial Sequence
  Description of Artificial Sequence: Synthetic oligonucleotide
gggaggacgaugcgguucguuugucccggcugcgucagacgacucgcccga

SEQ ID NO: 9695 - RNA, 51 nt, Artificial Sequence
  Description of Artificial Sequence: Synthetic oligonucleotide
gggaggacgaugcggcaaagcgccuccaacaguaccagacgacucgcccga

SEQ ID NO: 9696 - RNA, 51 nt, Artificial Sequence
  Description of Artificial Sequence: Synthetic oligonucleotide
gggaggacgaugcggauccaaggguaaaccaggugcagacgacucgcccga

SEQ ID NO: 9697 - RNA, 51 nt, Artificial Sequence
  Description of Artificial Sequence: Synthetic oligonucleotide
gggaggacgaugcgguaacaugcguacccccuccccagacgacucgcccga

SEQ ID NO: 9698 - RNA, 51 nt, Artificial Sequence
  Description of Artificial Sequence: Synthetic oligonucleotide
gggaggacgaugcgguuggguggagggcgguaccgcagacgacucgcccga

SEQ ID NO: 9699 - RNA, 51 nt, Artificial Sequence
  Description of Artificial Sequence: Synthetic oligonucleotide
gggaggacgaugcgguccgaauaauauugcgccgccagacgacucgcccga

SEQ ID NO: 9700 - RNA, 50 nt, Artificial Sequence
  Description of Artificial Sequence: Synthetic oligonucleotide
gggaggacgaugcgguccugugucuuugcguccccagacgacucgcccga

SEQ ID NO: 9701 - RNA, 51 nt, Artificial Sequence
  Description of Artificial Sequence: Synthetic oligonucleotide
gggaggacgaugcggcuggguguagggcgguaccgcagacgacucgcccga

SEQ ID NO: 9702 - RNA, 51 nt, Artificial Sequence
  Description of Artificial Sequence: Synthetic oligonucleotide
gggaggacgaugcgguaggaaaccuccuugcgugccagacgacucgcccga

SEQ ID NO: 9703 - RNA, 51 nt, Artificial Sequence
  Description of Artificial Sequence: Synthetic oligonucleotide
gggaggacgaugcggauagggagaagggugagccgcagacgacucgcccga

SEQ ID NO: 9704 - RNA, 51 nt, Artificial Sequence
  Description of Artificial Sequence: Synthetic oligonucleotide
gggaggacgaugcggguggccuguuccucuguccgcagacgacucgcccga

SEQ ID NO: 9705 - RNA, 51 nt, Artificial Sequence
  Description of Artificial Sequence: Synthetic oligonucleotide
gggaggacgaugcggcaaacgguuaaacuagcgugcagacgacucgcccga

SEQ ID NO: 9706 - RNA, 51 nt, Artificial Sequence
  Description of Artificial Sequence: Synthetic oligonucleotide
gggaggacgaugcggcaauagauaagcccggugcccagacgacucgcccga

SEQ ID NO: 9707 - RNA, 51 nt, Artificial Sequence
  Description of Artificial Sequence: Synthetic oligonucleotide
gggaggacgaugcgguccuugcucugcuguaugcccagacgacucgcccga

SEQ ID NO: 9708 - RNA, 51 nt, Artificial Sequence
  Description of Artificial Sequence: Synthetic oligonucleotide
gggaggacgaugcggacaguccucuugguugcccccagacgacucgcccga

SEQ ID NO: 9709 - RNA, 51 nt, Artificial Sequence
  Description of Artificial Sequence: Synthetic oligonucleotide
gggaggacgaugcgguguaggaggaggugggaccgcagacgacucgcccga

SEQ ID NO: 9710 - RNA, 51 nt, Artificial Sequence
  Description of Artificial Sequence: Synthetic oligonucleotide
gggaggacgaugcgguaccuccuaguggugguccccagacgacucgcccga

SEQ ID NO: 9711 - RNA, 51 nt, Artificial Sequence
  Description of Artificial Sequence: Synthetic oligonucleotide
gggaggacgaugcggaucaaccuuccugacgugugcagacgacucgcccga

SEQ ID NO: 9712 - RNA, 51 nt, Artificial Sequence
  Description of Artificial Sequence: Synthetic oligonucleotide
gggaggacgaugcggucaacucacaaaccugucgccagacgacucgcccga

SEQ ID NO: 9713 - RNA, 51 nt, Artificial Sequence
  Description of Artificial Sequence: Synthetic oligonucleotide
gggaggacgaugcggauuggagaagggaggaacugcagacgacucgcccga

SEQ ID NO: 9714 - RNA, 51 nt, Artificial Sequence
  Description of Artificial Sequence: Synthetic oligonucleotide
gggaggacgaugcgguugggagcagggugguaccgcagacgacucgcccga

SEQ ID NO: 9715 - RNA, 51 nt, Artificial Sequence
  Description of Artificial Sequence: Synthetic oligonucleotide
gggaggacgaugcggauugguggagggugggacugcagacgacucgcccga

SEQ ID NO: 9716 - RNA, 51 nt, Artificial Sequence
  Description of Artificial Sequence: Synthetic oligonucleotide
gggaggacgaugcgguugggaguauggugguaccgcagacgacucgcccga

SEQ ID NO: 9717 - RNA, 51 nt, Artificial Sequence
  Description of Artificial Sequence: Synthetic oligonucleotide
gggaggacgaugcgguuugaagggagauggguucgcagacgacucgcccga

SEQ ID NO: 9718 - RNA, 51 nt, Artificial Sequence
  Description of Artificial Sequence: Synthetic oligonucleotide
gggaggacgaugcggcaccgucgcuguuuacgccccagacgacucgcccga

SEQ ID NO: 9719 - RNA, 51 nt, Artificial Sequence
  Description of Artificial Sequence: Synthetic oligonucleotide
gggaggacgaugcggcuugaaggguguuggguccgcagacgacucgcccga

SEQ ID NO: 9720 - RNA, 51 nt, Artificial Sequence
  Description of Artificial Sequence: Synthetic oligonucleotide
gggaggacgaugcgguuugaagggugagggggccgcagacgacucgcccga

SEQ ID NO: 9721 - RNA, 51 nt, Artificial Sequence
  Description of Artificial Sequence: Synthetic oligonucleotide
gggaggacgaugcggacgaacaauggggguugccccagacgacucgcccga

SEQ ID NO: 9722 - RNA, 51 nt, Artificial Sequence
  Description of Artificial Sequence: Synthetic oligonucleotide
gggaggacgaugcgguuuggagaaggaugggaccgcagacgacucgcccga

SEQ ID NO: 9723 - RNA, 52 nt, Artificial Sequence
  Description of Artificial Sequence: Synthetic oligonucleotide
gggaggacgaugcgguuuugaagggagauggguccgcagacgacucgcccga

SEQ ID NO: 9724 - RNA, 50 nt, Artificial Sequence
  Description of Artificial Sequence: Synthetic oligonucleotide
gggaggacgaugcggaugaagggugauggguccgcagacgacucgcccga

SEQ ID NO: 9725 - RNA, 51 nt, Artificial Sequence
  Description of Artificial Sequence: Synthetic oligonucleotide
gggaggacgaugcgguuugaagggcgaucgguccgcagacgacucgcccga

SEQ ID NO: 9726 - RNA, 51 nt, Artificial Sequence
  Description of Artificial Sequence: Synthetic oligonucleotide
gggaggacgaugcgguuugaagggagaugggucggcagacgacucgcccga

SEQ ID NO: 9727 - RNA, 51 nt, Artificial Sequence
  Description of Artificial Sequence: Synthetic oligonucleotide
gggaggacgaugcggcuugucguuuuguucguccccagacgacucgcccga

SEQ ID NO: 9728 - RNA, 49 nt, Artificial Sequence
  Description of Artificial Sequence: Synthetic oligonucleotide
gggaggacgaugcggauuuggagaagggaggugcagacgacucgcccga

SEQ ID NO: 9729 - RNA, 51 nt, Artificial Sequence
  Description of Artificial Sequence: Synthetic oligonucleotide
gggaggacgaugcggauucccuccguucucguuaccagacgacucgcccga

SEQ ID NO: 9730 - RNA, 51 nt, Artificial Sequence
  Description of Artificial Sequence: Synthetic oligonucleotide
gggaggacgaugcgguuuaaagggugguggguccgcagacgacucgcccga

SEQ ID NO: 9731 - RNA, 51 nt, Artificial Sequence
  Description of Artificial Sequence: Synthetic oligonucleotide
gggaggacgaugcgguuugaagggugaugguuccccagacgacucgcccga

SEQ ID NO: 9732 - RNA, 49 nt, Artificial Sequence
  Description of Artificial Sequence: Synthetic oligonucleotide
gggaggacgaugcgggcuucguucugaccuccccagacgacucgcccga

SEQ ID NO: 9733 - RNA, 51 nt, Artificial Sequence
  Description of Artificial Sequence: Synthetic oligonucleotide
gggaggacgaugcgguuggaaggagggugguaccgcagacgacucgcccga

SEQ ID NO: 9734 - RNA, 51 nt, Artificial Sequence
  Description of Artificial Sequence: Synthetic oligonucleotide
gggaggacgaugcgguuugaagugcgauggguccgcagacgacucgcccga

SEQ ID NO: 9735 - RNA, 51 nt, Artificial Sequence
  Description of Artificial Sequence: Synthetic oligonucleotide
gggaggacgaugcgguuggaaggaggaugggaccgcagacgacucgcccga

SEQ ID NO: 9736 - RNA, 51 nt, Artificial Sequence
  Description of Artificial Sequence: Synthetic oligonucleotide
gggaggacgaugcgguaaaccguccauccuguccccagacgacucgcccga

SEQ ID NO: 9737 - RNA, 51 nt, Artificial Sequence
  Description of Artificial Sequence: Synthetic oligonucleotide
gggaggacgaugcgguucuccaucguugugcgccacagacgacucgcccga

SEQ ID NO: 9738 - RNA, 51 nt, Artificial Sequence
  Description of Artificial Sequence: Synthetic oligonucleotide
gggaggacgaugcgguuuggagggggaugguaccgcagacgacucgcccga

SEQ ID NO: 9739 - RNA, 51 nt, Artificial Sequence
  Description of Artificial Sequence: Synthetic oligonucleotide
gggaggacgaugcggcaagucgcuguuuuccugcccagacgacucgcccga

SEQ ID NO: 9740 - RNA, 51 nt, Artificial Sequence
  Description of Artificial Sequence: Synthetic oligonucleotide
gggaggacgaugcgguugggaggaggguggguccgcagacgacucgcccga

SEQ ID NO: 9741 - RNA, 51 nt, Artificial Sequence
  Description of Artificial Sequence: Synthetic oligonucleotide
gggaggacgaugcggcuugaagugugauggguccgcagacgacucgcccga

SEQ ID NO: 9742 - RNA, 51 nt, Artificial Sequence
  Description of Artificial Sequence: Synthetic oligonucleotide
gggaggacgaugcggguugaagugugauggguccgcagacgacucgcccga

SEQ ID NO: 9743 - RNA, 51 nt, Artificial Sequence
  Description of Artificial Sequence: Synthetic oligonucleotide
gggaggacgaugcgguuguguguagggggguaccgcagacgacucgcccga

SEQ ID NO: 9744 - RNA, 49 nt, Artificial Sequence
  Description of Artificial Sequence: Synthetic oligonucleotide
gggaggacgaugcgguuugaagggugaggggugcagacgacucgcccga

SEQ ID NO: 9745 - RNA, 51 nt, Artificial Sequence
  Description of Artificial Sequence: Synthetic oligonucleotide
gggaggacgaugcggauugggagaagggugaaccgcagacgacucgcccga

SEQ ID NO: 9746 - RNA, 52 nt, Artificial Sequence
  Description of Artificial Sequence: Synthetic oligonucleotide
gggaggacgaugcggagaucgauggguucucgugcccagacgacucgcccga

SEQ ID NO: 9747 - RNA, 51 nt, Artificial Sequence
  Description of Artificial Sequence: Synthetic oligonucleotide
gggaggacgaugcggcaagucguccuuggugugugcagacgacucgcccga

SEQ ID NO: 9748 - RNA, 51 nt, Artificial Sequence
  Description of Artificial Sequence: Synthetic oligonucleotide
gggaggacgaugcgguaucuaggcgccuaugacugcagacgacucgcccga

SEQ ID NO: 9749 - RNA, 51 nt, Artificial Sequence
  Description of Artificial Sequence: Synthetic oligonucleotide
gggaggacgaugcgguguagucggugcauuguggccagacgacucgcccga

SEQ ID NO: 9750 - RNA, 51 nt, Artificial Sequence
  Description of Artificial Sequence: Synthetic oligonucleotide
gggaggacgaugcggccuugucgucuguucguccccagacgacucgcccga

SEQ ID NO: 9751 - RNA, 51 nt, Artificial Sequence
  Description of Artificial Sequence: Synthetic oligonucleotide
gggaggacgaugcggcaaaaaaguaaaugucacugcagacgacucgcccga

SEQ ID NO: 9752 - RNA, 51 nt, Artificial Sequence
  Description of Artificial Sequence: Synthetic oligonucleotide
gggaggacgaugcggugagucuaaguauguggcugcagacgacucgcccga

SEQ ID NO: 9753 - RNA, 51 nt, Artificial Sequence
  Description of Artificial Sequence: Synthetic oligonucleotide
gggaggacgaugcgguccuugucgucuugcguccgcagacgacucgcccga

SEQ ID NO: 9754 - RNA, 50 nt, Artificial Sequence
  Description of Artificial Sequence: Synthetic oligonucleotide
gggaggacgaugcggcuauugguggaggguggugcagacgacucgcccga

SEQ ID NO: 9755 - RNA, 51 nt, Artificial Sequence
  Description of Artificial Sequence: Synthetic oligonucleotide
gggaggacgaugcgguaguaguuaauccugugccccagacgacucgcccga

SEQ ID NO: 9756 - RNA, 50 nt, Artificial Sequence
  Description of Artificial Sequence: Synthetic oligonucleotide
gggaggacgaugcgggcaacuaagccuccgugaccagacgacucgcccga

SEQ ID NO: 9757 - RNA, 51 nt, Artificial Sequence
  Description of Artificial Sequence: Synthetic oligonucleotide
gggaggacgaugcggguuucaagguaacgucuggccagacgacucgcccga

SEQ ID NO: 9758 - RNA, 51 nt, Artificial Sequence
  Description of Artificial Sequence: Synthetic oligonucleotide
gggaggacgaugcggcaucggugcuccgucguauacagacgacucgcccga

SEQ ID NO: 9759 - RNA, 51 nt, Artificial Sequence
  Description of Artificial Sequence: Synthetic oligonucleotide
gggaggacgaugcgguuggguggggggugguaccgcagacgacucgcccga

SEQ ID NO: 9760 - RNA, 51 nt, Artificial Sequence
  Description of Artificial Sequence: Synthetic oligonucleotide
gggaggacgaugcgggcguucaccgucggucugugcagacgacucgcccga

SEQ ID NO: 9761 - RNA, 51 nt, Artificial Sequence
  Description of Artificial Sequence: Synthetic oligonucleotide
gggaggacgaugcgguuagacaugacaggccgcgccagacgacucgcccga

SEQ ID NO: 9762 - RNA, 51 nt, Artificial Sequence
  Description of Artificial Sequence: Synthetic oligonucleotide
gggaggacgaugcgggauucgugcuggcauauguccagacgacucgcccga

SEQ ID NO: 9763 - RNA, 51 nt, Artificial Sequence
  Description of Artificial Sequence: Synthetic oligonucleotide
gggaggacgaugcggaaaaguccuugagugugccccagacgacucgcccga

SEQ ID NO: 9764 - RNA, 51 nt, Artificial Sequence
  Description of Artificial Sequence: Synthetic oligonucleotide
gggaggacgaugcgguguuccccuggaucguuggccagacgacucgcccga

SEQ ID NO: 9765 - RNA, 51 nt, Artificial Sequence
  Description of Artificial Sequence: Synthetic oligonucleotide
gggaggacgaugcgggauucguccccgaucguuggcagacgacucgcccga

SEQ ID NO: 9766 - RNA, 52 nt, Artificial Sequence
  Description of Artificial Sequence: Synthetic oligonucleotide
gggaggacgaugcgguaccgucguuuuuggcuuggccagacgacucgcccga

SEQ ID NO: 9767 - RNA, 51 nt, Artificial Sequence
  Description of Artificial Sequence: Synthetic oligonucleotide
gggaggacgaugcggcccugugaaaaugugcugugcagacgacucgcccga

SEQ ID NO: 9768 - RNA, 49 nt, Artificial Sequence
  Description of Artificial Sequence: Synthetic oligonucleotide
gggaggacgaugcgguuggcuugucguuguccccagacgacucgcccga

SEQ ID NO: 9769 - RNA, 51 nt, Artificial Sequence
  Description of Artificial Sequence: Synthetic oligonucleotide
gggaggacgaugcgguccagcuccuuucaccuccccagacgacucgcccga

SEQ ID NO: 9770 - RNA, 51 nt, Artificial Sequence
  Description of Artificial Sequence: Synthetic oligonucleotide
gggaggacgaugcggcgugcucauacggucuggcccagacgacucgcccga

SEQ ID NO: 9771 - RNA, 51 nt, Artificial Sequence
  Description of Artificial Sequence: Synthetic oligonucleotide
gggaggacgaugcggaaaucagugugccgcgacaccagacgacucgcccga

SEQ ID NO: 9772 - RNA, 51 nt, Artificial Sequence
  Description of Artificial Sequence: Synthetic oligonucleotide
gggaggacgaugcggauucgguaaaguuacgucugcagacgacucgcccga

SEQ ID NO: 9773 - RNA, 51 nt, Artificial Sequence
  Description of Artificial Sequence: Synthetic oligonucleotide
gggaggacgaugcgggccaaauguccucugcgcgccagacgacucgcccga

SEQ ID NO: 9774 - RNA, 51 nt, Artificial Sequence
  Description of Artificial Sequence: Synthetic oligonucleotide
gggaggacgaugcggaaucguuacuuaucgcuggucagacgacucgcccga

SEQ ID NO: 9775 - RNA, 51 nt, Artificial Sequence
  Description of Artificial Sequence: Synthetic oligonucleotide
gggaggacgaugcggaaugauauccucauuacgugcagacgacucgcccga

SEQ ID NO: 9776 - RNA, 51 nt, Artificial Sequence
  Description of Artificial Sequence: Synthetic oligonucleotide
gggaggacgaugcggucuggcaacaugcuccaccccagacgacucgcccga

SEQ ID NO: 9777 - RNA, 51 nt, Artificial Sequence
  Description of Artificial Sequence: Synthetic oligonucleotide
gggaggacgaugcggaggacgguguucggucaguacagacgacucgcccga

SEQ ID NO: 9778 - RNA, 51 nt, Artificial Sequence
  Description of Artificial Sequence: Synthetic oligonucleotide
gggaggacgaugcgggagcgaugauaugacauccgcagacgacucgcccga

SEQ ID NO: 9779 - RNA, 51 nt, Artificial Sequence
  Description of Artificial Sequence: Synthetic oligonucleotide
gggaggacgaugcgguuggguggaggguguuaccgcagacgacucgcccga

SEQ ID NO: 9780 - RNA, 51 nt, Artificial Sequence
  Description of Artificial Sequence: Synthetic oligonucleotide
gggaggacgaugcggauacgauccuccaggugccccagacgacucgcccga

SEQ ID NO: 9781 - RNA, 51 nt, Artificial Sequence
  Description of Artificial Sequence: Synthetic oligonucleotide
gggaggacgaugcggcauccguccggcguacaugccagacgacucgcccga

SEQ ID NO: 9782 - RNA, 51 nt, Artificial Sequence
  Description of Artificial Sequence: Synthetic oligonucleotide
gggaggacgaugcggucacccuuggcuuuccaccgcagacgacucgcccga

SEQ ID NO: 9783 - RNA, 51 nt, Artificial Sequence
  Description of Artificial Sequence: Synthetic oligonucleotide
gggaggacgaugcggcguugcgaucuguccgugugcagacgacucgcccga

SEQ ID NO: 9784 - RNA, 51 nt, Artificial Sequence
  Description of Artificial Sequence: Synthetic oligonucleotide
gggaggacgaugcgggugcgucaugucugucugcccagacgacucgcccga

SEQ ID NO: 9785 - RNA, 51 nt, Artificial Sequence
  Description of Artificial Sequence: Synthetic oligonucleotide
gggaggacgaugcgguugggugcagggagguaccgcagacgacucgcccga

SEQ ID NO: 9786 - RNA, 51 nt, Artificial Sequence
  Description of Artificial Sequence: Synthetic oligonucleotide
gggaggacgaugcggcuaagaggaggagaugggagcagacgacucgcccga

SEQ ID NO: 9787 - RNA, 51 nt, Artificial Sequence
  Description of Artificial Sequence: Synthetic oligonucleotide
gggaggacgaugcggcaucgugcacuccgcguguccagacgacucgcccga

SEQ ID NO: 9788 - RNA, 51 nt, Artificial Sequence
  Description of Artificial Sequence: Synthetic oligonucleotide
gggaggacgaugcgguuagcugcgcacagcaugcccagacgacucgcccga

SEQ ID NO: 9789 - RNA, 51 nt, Artificial Sequence
  Description of Artificial Sequence: Synthetic oligonucleotide
gggaggacgaugcggucuuccauuagcgcagugcccagacgacucgcccga

SEQ ID NO: 9790 - RNA, 51 nt, Artificial Sequence
  Description of Artificial Sequence: Synthetic oligonucleotide
gggaggacgaugcggaacaagccucuccguugccccagacgacucgcccga

SEQ ID NO: 9791 - RNA, 51 nt, Artificial Sequence
  Description of Artificial Sequence: Synthetic oligonucleotide
gggaggacgaugcgguaagcacgauaauccccccccagacgacucgcccga

SEQ ID NO: 9792 - RNA, 51 nt, Artificial Sequence
  Description of Artificial Sequence: Synthetic oligonucleotide
gggaggacgaugcgggauugggucgucccacugugcagacgacucgcccga

SEQ ID NO: 9793 - RNA, 51 nt, Artificial Sequence
  Description of Artificial Sequence: Synthetic oligonucleotide
gggaggacgaugcggcuugcguuauggcguugugccagacgacucgcccga

SEQ ID NO: 9794 - RNA, 51 nt, Artificial Sequence
  Description of Artificial Sequence: Synthetic oligonucleotide
gggaggacgaugcgguugaguguaggguguuaccgcagacgacucgcccga

SEQ ID NO: 9795 - RNA, 51 nt, Artificial Sequence
  Description of Artificial Sequence: Synthetic oligonucleotide
gggaggacgaugcggaaccauggcuuccccguguccagacgacucgcccga

SEQ ID NO: 9796 - RNA, 51 nt, Artificial Sequence
  Description of Artificial Sequence: Synthetic oligonucleotide
gggaggacgaugcggguuugguaagcgccucugugcagacgacucgcccga

SEQ ID NO: 9797 - RNA, 51 nt, Artificial Sequence
  Description of Artificial Sequence: Synthetic oligonucleotide
gggaggacgaugcggauaacuggguacucuggccgcagacgacucgcccga

SEQ ID NO: 9798 - RNA, 51 nt, Artificial Sequence
  Description of Artificial Sequence: Synthetic oligonucleotide
gggaggacgaugcggagucgcugauguugucgcugcagacgacucgcccga

SEQ ID NO: 9799 - RNA, 51 nt, Artificial Sequence
  Description of Artificial Sequence: Synthetic oligonucleotide
gggaggacgaugcggucuguccgggucugucgcuacagacgacucgcccga

SEQ ID NO: 9800 - RNA, 51 nt, Artificial Sequence
  Description of Artificial Sequence: Synthetic oligonucleotide
gggaggacgaugcggacggcuauuaagcuacucgccagacgacucgcccga

SEQ ID NO: 9801 - RNA, 51 nt, Artificial Sequence
  Description of Artificial Sequence: Synthetic oligonucleotide
gggaggacgaugcggguagugcucugguacgcggccagacgacucgcccga

SEQ ID NO: 9802 - RNA, 51 nt, Artificial Sequence
  Description of Artificial Sequence: Synthetic oligonucleotide
gggaggacgaugcggaaagaacaccucaucuuguccagacgacucgcccga

SEQ ID NO: 9803 - RNA, 51 nt, Artificial Sequence
  Description of Artificial Sequence: Synthetic oligonucleotide
gggaggacgaugcgguauucgagcacauacgugugcagacgacucgcccga

SEQ ID NO: 9804 - RNA, 51 nt, Artificial Sequence
  Description of Artificial Sequence: Synthetic oligonucleotide
gggaggacgaugcggaccuccaauaauaugugcgccagacgacucgcccga

SEQ ID NO: 9805 - RNA, 51 nt, Artificial Sequence
  Description of Artificial Sequence: Synthetic oligonucleotide
gggaggacgaugcgggugacggugccuugagugugcagacgacucgcccga

SEQ ID NO: 9806 - RNA, 51 nt, Artificial Sequence
  Description of Artificial Sequence: Synthetic oligonucleotide
gggaggacgaugcggucuaaacucuccugcaccugcagacgacucgcccga

SEQ ID NO: 9807 - RNA, 51 nt, Artificial Sequence
  Description of Artificial Sequence: Synthetic oligonucleotide
gggaggacgaugcggacgagcgaguaugugcgcaccagacgacucgcccga

SEQ ID NO: 9808 - RNA, 51 nt, Artificial Sequence
  Description of Artificial Sequence: Synthetic oligonucleotide
gggaggacgaugcgguauccggaacgugcugucgccagacgacucgcccga

SEQ ID NO: 9809 - RNA, 51 nt, Artificial Sequence
  Description of Artificial Sequence: Synthetic oligonucleotide
gggaggacgaugcggucuaaagugcacuguguccccagacgacucgcccga

SEQ ID NO: 9810 - RNA, 50 nt, Artificial Sequence
  Description of Artificial Sequence: Synthetic oligonucleotide
gggaggacgaugcggucuugucgucuugcguccccagacgacucgcccga

SEQ ID NO: 9811 - RNA, 51 nt, Artificial Sequence
  Description of Artificial Sequence: Synthetic oligonucleotide
gggaggacgaugcgguacgaaagaacaaucuugugcagacgacucgcccga

SEQ ID NO: 9812 - RNA, 51 nt, Artificial Sequence
  Description of Artificial Sequence: Synthetic oligonucleotide
gggaggacgaugcgggaauagugugugugguuggccagacgacucgcccga

SEQ ID NO: 9813 - RNA, 51 nt, Artificial Sequence
  Description of Artificial Sequence: Synthetic oligonucleotide
gggaggacgaugcggcguucacccugucguuuggccagacgacucgcccga

SEQ ID NO: 9814 - RNA, 52 nt, Artificial Sequence
  Description of Artificial Sequence: Synthetic oligonucleotide
gggaggacgaugcggguccugucgucuguucuuccccagacgacucgcccga

SEQ ID NO: 9815 - RNA, 51 nt, Artificial Sequence
  Description of Artificial Sequence: Synthetic oligonucleotide
gggaggacgaugcggaugucuauggcuacacgggccagacgacucgcccga

SEQ ID NO: 9816 - RNA, 51 nt, Artificial Sequence
  Description of Artificial Sequence: Synthetic oligonucleotide
gggaggacgaugcgguaccgagaguucuucaccgccagacgacucgcccga

SEQ ID NO: 9817 - RNA, 51 nt, Artificial Sequence
  Description of Artificial Sequence: Synthetic oligonucleotide
gggaggacgaugcggccauguuaacagucacuccccagacgacucgcccga

SEQ ID NO: 9818 - RNA, 51 nt, Artificial Sequence
  Description of Artificial Sequence: Synthetic oligonucleotide
gggaggacgaugcggucacaguagcaugccguccccagacgacucgcccga

SEQ ID NO: 9819 - RNA, 51 nt, Artificial Sequence
  Description of Artificial Sequence: Synthetic oligonucleotide
gggaggacgaugcggccgugucgucuguucguccccagacgacucgcccga

SEQ ID NO: 9820 - RNA, 51 nt, Artificial Sequence
  Description of Artificial Sequence: Synthetic oligonucleotide
gggaggacgaugcgguccauucccguuaacggccgcagacgacucgcccga

SEQ ID NO: 9821 - RNA, 51 nt, Artificial Sequence
  Description of Artificial Sequence: Synthetic oligonucleotide
gggaggacgaugcgguaccucggcuucugugugcacagacgacucgcccga

SEQ ID NO: 9822 - RNA, 51 nt, Artificial Sequence
  Description of Artificial Sequence: Synthetic oligonucleotide
gggaggacgaugcggugugguugucuggugaugugcagacgacucgcccga

SEQ ID NO: 9823 - RNA, 51 nt, Artificial Sequence
  Description of Artificial Sequence: Synthetic oligonucleotide
gggaggacgaugcggacggcgcguugucucgucaccagacgacucgcccga

SEQ ID NO: 9824 - RNA, 51 nt, Artificial Sequence
  Description of Artificial Sequence: Synthetic oligonucleotide
gggaggacgaugcgggugauuguugaggucuggcccagacgacucgcccga

SEQ ID NO: 9825 - RNA, 51 nt, Artificial Sequence
  Description of Artificial Sequence: Synthetic oligonucleotide
gggaggacgaugcggucauuuauuccgucugugcccagacgacucgcccga

SEQ ID NO: 9826 - RNA, 51 nt, Artificial Sequence
  Description of Artificial Sequence: Synthetic oligonucleotide
gggaggacgaugcggguacgugaacucguuguggccagacgacucgcccga

SEQ ID NO: 9827 - RNA, 51 nt, Artificial Sequence
  Description of Artificial Sequence: Synthetic oligonucleotide
gggaggacgaugcggcauaagugagugugagcccccagacgacucgcccga

SEQ ID NO: 9828 - RNA, 51 nt, Artificial Sequence
  Description of Artificial Sequence: Synthetic oligonucleotide
gggaggacgaugcgguguaauuaguuuguacugugcagacgacucgcccga

SEQ ID NO: 9829 - RNA, 51 nt, Artificial Sequence
  Description of Artificial Sequence: Synthetic oligonucleotide
gggaggacgaugcgguuucacgucaugccuguguccagacgacucgcccga

SEQ ID NO: 9830 - RNA, 51 nt, Artificial Sequence
  Description of Artificial Sequence: Synthetic oligonucleotide
gggaggacgaugcgguuagcuugacgugccgcgugcagacgacucgcccga

SEQ ID NO: 9831 - RNA, 51 nt, Artificial Sequence
  Description of Artificial Sequence: Synthetic oligonucleotide
gggaggacgaugcgguccuuucgaguauucgucugcagacgacucgcccga

SEQ ID NO: 9832 - RNA, 51 nt, Artificial Sequence
  Description of Artificial Sequence: Synthetic oligonucleotide
gggaggacgaugcgguuugaugggugauggguccccagacgacucgcccga

SEQ ID NO: 9833 - RNA, 51 nt, Artificial Sequence
  Description of Artificial Sequence: Synthetic oligonucleotide
gggaggacgaugcggccugcaacauugugccauaccagacgacucgcccga

SEQ ID NO: 9834 - RNA, 51 nt, Artificial Sequence
  Description of Artificial Sequence: Synthetic oligonucleotide
gggaggacgaugcggauacauugugacuaccgugccagacgacucgcccga

SEQ ID NO: 9835 - RNA, 51 nt, Artificial Sequence
  Description of Artificial Sequence: Synthetic oligonucleotide
gggaggacgaugcggaccuuaacaauucugcggcccagacgacucgcccga

SEQ ID NO: 9836 - RNA, 51 nt, Artificial Sequence
  Description of Artificial Sequence: Synthetic oligonucleotide
gggaggacgaugcgguuugaagggugauagguccccagacgacucgcccga

SEQ ID NO: 9837 - RNA, 51 nt, Artificial Sequence
  Description of Artificial Sequence: Synthetic oligonucleotide
gggaggacgaugcggaaacaccuccuaugcgugaccagacgacucgcccga

SEQ ID NO: 9838 - RNA, 51 nt, Artificial Sequence
  Description of Artificial Sequence: Synthetic oligonucleotide
gggaggacgaugcggucgucgcguaacucugccugcagacgacucgcccga

SEQ ID NO: 9839 - RNA, 51 nt, Artificial Sequence
  Description of Artificial Sequence: Synthetic oligonucleotide
gggaggacgaugcggcccaguagucugcaccuguacagacgacucgcccga

SEQ ID NO: 9840 - RNA, 51 nt, Artificial Sequence
  Description of Artificial Sequence: Synthetic oligonucleotide
gggaggacgaugcggacacuccauuaagccuccugcagacgacucgcccga

SEQ ID NO: 9841 - RNA, 51 nt, Artificial Sequence
  Description of Artificial Sequence: Synthetic oligonucleotide
gggaggacgaugcggucugcguaucguuugugccccagacgacucgcccga

SEQ ID NO: 9842 - RNA, 51 nt, Artificial Sequence
  Description of Artificial Sequence: Synthetic oligonucleotide
gggaggacgaugcggcgaugguucucuucagugugcagacgacucgcccga

SEQ ID NO: 9843 - RNA, 51 nt, Artificial Sequence
  Description of Artificial Sequence: Synthetic oligonucleotide
gggaggacgaugcggauagccgaucuuugccacgucagacgacucgcccga

SEQ ID NO: 9844 - RNA, 51 nt, Artificial Sequence
  Description of Artificial Sequence: Synthetic oligonucleotide
gggaggacgaugcggauuggugaagggagguaacgcagacgacucgcccga

SEQ ID NO: 9845 - RNA, 51 nt, Artificial Sequence
  Description of Artificial Sequence: Synthetic oligonucleotide
gggaggacgaugcggcgauucaccuggcuccgcaccagacgacucgcccga

SEQ ID NO: 9846 - RNA, 51 nt, Artificial Sequence
  Description of Artificial Sequence: Synthetic oligonucleotide
gggaggacgaugcgguugaucauccucgcugcgugcagacgacucgcccga

SEQ ID NO: 9847 - RNA, 51 nt, Artificial Sequence
  Description of Artificial Sequence: Synthetic oligonucleotide
gggaggacgaugcggcucuaguuccuccugugugccagacgacucgcccga

SEQ ID NO: 9848 - RNA, 51 nt, Artificial Sequence
  Description of Artificial Sequence: Synthetic oligonucleotide
gggaggacgaugcggaccgugucugugguguggugcagacgacucgcccga

SEQ ID NO: 9849 - RNA, 51 nt, Artificial Sequence
  Description of Artificial Sequence: Synthetic oligonucleotide
gggaggacgaugcggauaagugguuguagucgugccagacgacucgcccga

SEQ ID NO: 9850 - RNA, 51 nt, Artificial Sequence
  Description of Artificial Sequence: Synthetic oligonucleotide
gggaggacgaugcgguaucaauuggaauggugcgccagacgacucgcccga

SEQ ID NO: 9851 - RNA, 51 nt, Artificial Sequence
  Description of Artificial Sequence: Synthetic oligonucleotide
gggaggacgaugcggugacucgucuauuucguccccagacgacucgcccga

SEQ ID NO: 9852 - RNA, 51 nt, Artificial Sequence
  Description of Artificial Sequence: Synthetic oligonucleotide
gggaggacgaugcgguucgugggcuaugacgcgcccagacgacucgcccga

SEQ ID NO: 9853 - RNA, 51 nt, Artificial Sequence
  Description of Artificial Sequence: Synthetic oligonucleotide
gggaggacgaugcgggaacauguaacaaggugcugcagacgacucgcccga

SEQ ID NO: 9854 - RNA, 51 nt, Artificial Sequence
  Description of Artificial Sequence: Synthetic oligonucleotide
gggaggacgaugcgguucguguaucugggugcuaccagacgacucgcccga

SEQ ID NO: 9855 - RNA, 51 nt, Artificial Sequence
  Description of Artificial Sequence: Synthetic oligonucleotide
gggaggacgaugcggcguuuccucugguucguccacagacgacucgcccga

SEQ ID NO: 9856 - RNA, 50 nt, Artificial Sequence
  Description of Artificial Sequence: Synthetic oligonucleotide
gggaggacgaugcgggcgaagggugauggguccgcagacgacucgcccga

SEQ ID NO: 9857 - RNA, 51 nt, Artificial Sequence
  Description of Artificial Sequence: Synthetic oligonucleotide
gggaggacgaugcgguggucuacgcguaucgugugcagacgacucgcccga

SEQ ID NO: 9858 - RNA, 51 nt, Artificial Sequence
  Description of Artificial Sequence: Synthetic oligonucleotide
gggaggacgaugcgguuugaagggcgaugggucggcagacgacucgcccga

SEQ ID NO: 9859 - RNA, 51 nt, Artificial Sequence
  Description of Artificial Sequence: Synthetic oligonucleotide
gggaggacgaugcggugacucguccguuucguccccagacgacucgcccga

SEQ ID NO: 9860 - RNA, 51 nt, Artificial Sequence
  Description of Artificial Sequence: Synthetic oligonucleotide
gggaggacgaugcggaacuccuucucucggcucgccagacgacucgcccga

SEQ ID NO: 9861 - RNA, 49 nt, Artificial Sequence
  Description of Artificial Sequence: Synthetic oligonucleotide
gggaggacgaugcgguuugaagugauggguccgcagacgacucgcccga

SEQ ID NO: 9862 - RNA, 51 nt, Artificial Sequence
  Description of Artificial Sequence: Synthetic oligonucleotide
gggaggacgaugcgguauuggagguguagggaccucagacgacucgcccga

SEQ ID NO: 9863 - RNA, 50 nt, Artificial Sequence
  Description of Artificial Sequence: Synthetic oligonucleotide
gggaggacgaugcgguuuuugggugauggguccgcagacgacucgcccga

SEQ ID NO: 9864 - RNA, 51 nt, Artificial Sequence
  Description of Artificial Sequence: Synthetic oligonucleotide
gggaggacgaugcgguauuguagguguagggaccgcagacgacucgcccga

SEQ ID NO: 9865 - RNA, 51 nt, Artificial Sequence
  Description of Artificial Sequence: Synthetic oligonucleotide
gggaggacgaugcgguuugaagggggacggguccgcagacgacucgcccga

SEQ ID NO: 9866 - RNA, 51 nt, Artificial Sequence
  Description of Artificial Sequence: Synthetic oligonucleotide
gggaggacgaugcggugagucccuagguaugcccccagacgacucgcccga

SEQ ID NO: 9867 - RNA, 51 nt, Artificial Sequence
  Description of Artificial Sequence: Synthetic oligonucleotide
gggaggacgaugcggcuugaagggugaugaguccgcagacgacucgcccga

SEQ ID NO: 9868 - RNA, 51 nt, Artificial Sequence
  Description of Artificial Sequence: Synthetic oligonucleotide
gggaggacgaugcgguuggguguuggguguuaccgcagacgacucgcccga

SEQ ID NO: 9869 - RNA, 50 nt, Artificial Sequence
  Description of Artificial Sequence: Synthetic oligonucleotide
gggaggacgaugcgguugguguagggugguacugcagacgacucgcccga

SEQ ID NO: 9870 - RNA, 51 nt, Artificial Sequence
  Description of Artificial Sequence: Synthetic oligonucleotide
gggaggacgaugcggagagucuaugagugugaccccagacgacucgcccga

SEQ ID NO: 9871 - RNA, 51 nt, Artificial Sequence
  Description of Artificial Sequence: Synthetic oligonucleotide
gggaggacgaugcgguuugaaggcggauggguccgcagacgacucgcccga

SEQ ID NO: 9872 - RNA, 51 nt, Artificial Sequence
  Description of Artificial Sequence: Synthetic oligonucleotide
gggaggacgaugcgguuauguucaagugacguggccagacgacucgcccga

SEQ ID NO: 9873 - RNA, 51 nt, Artificial Sequence
  Description of Artificial Sequence: Synthetic oligonucleotide
gggaggacgaugcggggcgguaaacacgcuguggccagacgacucgcccga

SEQ ID NO: 9874 - RNA, 51 nt, Artificial Sequence
  Description of Artificial Sequence: Synthetic oligonucleotide
gggaggacgaugcggugcgucaucugguucauggccagacgacucgcccga

SEQ ID NO: 9875 - RNA, 51 nt, Artificial Sequence
  Description of Artificial Sequence: Synthetic oligonucleotide
gggaggacgaugcgggucgagaucgacucguuugccagacgacucgcccga

SEQ ID NO: 9876 - RNA, 51 nt, Artificial Sequence
  Description of Artificial Sequence: Synthetic oligonucleotide
gggaggacgaugcgguuggguguauggcgguaccgcagacgacucgcccga

SEQ ID NO: 9877 - RNA, 51 nt, Artificial Sequence
  Description of Artificial Sequence: Synthetic oligonucleotide
gggaggacgaugcggccauucgagcuggcagugcccagacgacucgcccga

SEQ ID NO: 9878 - RNA, 49 nt, Artificial Sequence
  Description of Artificial Sequence: Synthetic oligonucleotide
gggaggacgaugcgguuugaaggaugauguccgcagacgacucgcccga

SEQ ID NO: 9879 - RNA, 51 nt, Artificial Sequence
  Description of Artificial Sequence: Synthetic oligonucleotide
gggaggacgaugcgguggccguaaaaguguggccccagacgacucgcccga

SEQ ID NO: 9880 - RNA, 51 nt, Artificial Sequence
  Description of Artificial Sequence: Synthetic oligonucleotide
gggaggacgaugcgguucacuguaguauccacuaccagacgacucgcccga

SEQ ID NO: 9881 - RNA, 51 nt, Artificial Sequence
  Description of Artificial Sequence: Synthetic oligonucleotide
gggaggacgaugcgguugggugaaggguggcaccgcagacgacucgcccga

SEQ ID NO: 9882 - RNA, 51 nt, Artificial Sequence
  Description of Artificial Sequence: Synthetic oligonucleotide
gggaggacgaugcgguaucguauuguuuaucccaccagacgacucgcccga

SEQ ID NO: 9883 - RNA, 50 nt, Artificial Sequence
  Description of Artificial Sequence: Synthetic oligonucleotide
gggaggacgaugcgggcuuucguucagcccuccccagacgacucgcccga

SEQ ID NO: 9884 - RNA, 51 nt, Artificial Sequence
  Description of Artificial Sequence: Synthetic oligonucleotide
gggaggacgaugcggcaagucauuagggcuguugccagacgacucgcccga

SEQ ID NO: 9885 - RNA, 51 nt, Artificial Sequence
  Description of Artificial Sequence: Synthetic oligonucleotide
gggaggacgaugcgguguguugucugucugggguccagacgacucgcccga

SEQ ID NO: 9886 - RNA, 51 nt, Artificial Sequence
  Description of Artificial Sequence: Synthetic oligonucleotide
gggaggacgaugcgguccuuguugucuugcguccccagacgacucgcccga

SEQ ID NO: 9887 - RNA, 51 nt, Artificial Sequence
  Description of Artificial Sequence: Synthetic oligonucleotide
gggaggacgaugcgguguaaagucgucccgugccccagacgacucgcccga

SEQ ID NO: 9888 - RNA, 51 nt, Artificial Sequence
  Description of Artificial Sequence: Synthetic oligonucleotide
gggaggacgaugcgguugggaggaggauggguccgcagacgacucgcccga

SEQ ID NO: 9889 - RNA, 51 nt, Artificial Sequence
  Description of Artificial Sequence: Synthetic oligonucleotide
gggaggacgaugcgguguugcuauggacugugccgcagacgacucgcccga

SEQ ID NO: 9890 - RNA, 51 nt, Artificial Sequence
  Description of Artificial Sequence: Synthetic oligonucleotide
gggaggacgaugcggcacagugagugaugccgguacagacgacucgcccga

SEQ ID NO: 9891 - RNA, 52 nt, Artificial Sequence
  Description of Artificial Sequence: Synthetic oligonucleotide
gggaggacgaugcgguuuugggguuuucccgugccccagacgacucgcccga

SEQ ID NO: 9892 - RNA, 51 nt, Artificial Sequence
  Description of Artificial Sequence: Synthetic oligonucleotide
gggaggacgaugcgguguagggagguaguuauccgcagacgacucgcccga

SEQ ID NO: 9893 - RNA, 51 nt, Artificial Sequence
  Description of Artificial Sequence: Synthetic oligonucleotide
gggaggacgaugcgggauccuccuaauugcgccgccagacgacucgcccga

SEQ ID NO: 9894 - RNA, 50 nt, Artificial Sequence
  Description of Artificial Sequence: Synthetic oligonucleotide
gggaggacgaugcgguugaagggugaugggcccgcagacgacucgcccga

SEQ ID NO: 9895 - RNA, 51 nt, Artificial Sequence
  Description of Artificial Sequence: Synthetic oligonucleotide
gggaggacgaugcgggaaguugcgcugcacguguccagacgacucgcccga

SEQ ID NO: 9896 - RNA, 51 nt, Artificial Sequence
  Description of Artificial Sequence: Synthetic oligonucleotide
gggaggacgaugcgguuggaagugggaugggaccgcagacgacucgcccga

SEQ ID NO: 9897 - RNA, 51 nt, Artificial Sequence
  Description of Artificial Sequence: Synthetic oligonucleotide
gggaggacgaugcggcuggauauacuccugauccccagacgacucgcccga

SEQ ID NO: 9898 - RNA, 51 nt, Artificial Sequence
  Description of Artificial Sequence: Synthetic oligonucleotide
gggaggacgaugcgguuggguguaggaugggaccgcagacgacucgcccga

SEQ ID NO: 9899 - RNA, 51 nt, Artificial Sequence
  Description of Artificial Sequence: Synthetic oligonucleotide
gggaggacgaugcggcuaacgaugauacagguccacagacgacucgcccga

SEQ ID NO: 9900 - RNA, 51 nt, Artificial Sequence
  Description of Artificial Sequence: Synthetic oligonucleotide
gggaggacgaugcggacggaugacuagacccacugcagacgacucgcccga

SEQ ID NO: 9901 - RNA, 51 nt, Artificial Sequence
  Description of Artificial Sequence: Synthetic oligonucleotide
gggaggacgaugcggcaugaccacacuccuguccccagacgacucgcccga

SEQ ID NO: 9902 - RNA, 51 nt, Artificial Sequence
  Description of Artificial Sequence: Synthetic oligonucleotide
gggaggacgaugcggauuggcgaagggcgguacugcagacgacucgcccga

SEQ ID NO: 9903 - RNA, 51 nt, Artificial Sequence
  Description of Artificial Sequence: Synthetic oligonucleotide
gggaggacgaugcgguugucuguguggauugcguacagacgacucgcccga

SEQ ID NO: 9904 - RNA, 51 nt, Artificial Sequence
  Description of Artificial Sequence: Synthetic oligonucleotide
gggaggacgaugcggaacaucgugucgaagcuccccagacgacucgcccga

SEQ ID NO: 9905 - RNA, 51 nt, Artificial Sequence
  Description of Artificial Sequence: Synthetic oligonucleotide
gggaggacgaugcggcucaucaccauacugucgugcagacgacucgcccga

SEQ ID NO: 9906 - RNA, 51 nt, Artificial Sequence
  Description of Artificial Sequence: Synthetic oligonucleotide
gggaggacgaugcggaaguccaaucuuuugcgcgccagacgacucgcccga

SEQ ID NO: 9907 - RNA, 51 nt, Artificial Sequence
  Description of Artificial Sequence: Synthetic oligonucleotide
gggaggacgaugcggucuccuaguaauuugucguccagacgacucgcccga

SEQ ID NO: 9908 - RNA, 51 nt, Artificial Sequence
  Description of Artificial Sequence: Synthetic oligonucleotide
gggaggacgaugcggucgagagucagccacuucgccagacgacucgcccga

SEQ ID NO: 9909 - RNA, 51 nt, Artificial Sequence
  Description of Artificial Sequence: Synthetic oligonucleotide
gggaggacgaugcggguugaagggugauggggccgcagacgacucgcccga

SEQ ID NO: 9910 - RNA, 51 nt, Artificial Sequence
  Description of Artificial Sequence: Synthetic oligonucleotide
gggaggacgaugcgguuggauguagggugggaccgcagacgacucgcccga

SEQ ID NO: 9911 - RNA, 51 nt, Artificial Sequence
  Description of Artificial Sequence: Synthetic oligonucleotide
gggaggacgaugcgguuugaagggggaucgguccgcagacgacucgcccga

SEQ ID NO: 9912 - RNA, 49 nt, Artificial Sequence
  Description of Artificial Sequence: Synthetic oligonucleotide
gggaggacgaugcggaaugaacguccuaugcugcagacgacucgcccga

SEQ ID NO: 9913 - RNA, 51 nt, Artificial Sequence
  Description of Artificial Sequence: Synthetic oligonucleotide
gggaggacgaugcggucucuggacaacccgguugccagacgacucgcccga

SEQ ID NO: 9914 - RNA, 51 nt, Artificial Sequence
  Description of Artificial Sequence: Synthetic oligonucleotide
gggaggacgaugcgguaggcaacauggacaugcugcagacgacucgcccga

SEQ ID NO: 9915 - RNA, 51 nt, Artificial Sequence
  Description of Artificial Sequence: Synthetic oligonucleotide
gggaggacgaugcgguugggagggggguggguccgcagacgacucgcccga

SEQ ID NO: 9916 - RNA, 51 nt, Artificial Sequence
  Description of Artificial Sequence: Synthetic oligonucleotide
gggaggacgaugcgguugggguuggagauggacugcagacgacucgcccga

SEQ ID NO: 9917 - RNA, 52 nt, Artificial Sequence
  Description of Artificial Sequence: Synthetic oligonucleotide
gggaggacgaugcgguauuggagguguaggggaccgcagacgacucgcccga

SEQ ID NO: 9918 - RNA, 51 nt, Artificial Sequence
  Description of Artificial Sequence: Synthetic oligonucleotide
gggaggacgaugcggcauucauagucucccguggccagacgacucgcccga

SEQ ID NO: 9919 - RNA, 51 nt, Artificial Sequence
  Description of Artificial Sequence: Synthetic oligonucleotide
gggaggacgaugcggcgcuagaccuacaugcugcccagacgacucgcccga

SEQ ID NO: 9920 - RNA, 51 nt, Artificial Sequence
  Description of Artificial Sequence: Synthetic oligonucleotide
gggaggacgaugcggugcgauguaagcuggugcgccagacgacucgcccga

SEQ ID NO: 9921 - RNA, 51 nt, Artificial Sequence
  Description of Artificial Sequence: Synthetic oligonucleotide
gggaggacgaugcgguuccucuacucccuagcguacagacgacucgcccga

SEQ ID NO: 9922 - RNA, 51 nt, Artificial Sequence
  Description of Artificial Sequence: Synthetic oligonucleotide
gggaggacgaugcggauaucgucuccuucgcucugcagacgacucgcccga

SEQ ID NO: 9923 - RNA, 51 nt, Artificial Sequence
  Description of Artificial Sequence: Synthetic oligonucleotide
gggaggacgaugcgguauuggagauguagggaccgcagacgacucgcccga

SEQ ID NO: 9924 - RNA, 51 nt, Artificial Sequence
  Description of Artificial Sequence: Synthetic oligonucleotide
gggaggacgaugcggccauuguccuugauguaccgcagacgacucgcccga

SEQ ID NO: 9925 - RNA, 51 nt, Artificial Sequence
  Description of Artificial Sequence: Synthetic oligonucleotide
gggaggacgaugcgguccgaagggugauggguccgcagacgacucgcccga

SEQ ID NO: 9926 - RNA, 51 nt, Artificial Sequence
  Description of Artificial Sequence: Synthetic oligonucleotide
gggaggacgaugcggaaccacgaugcugccagccgcagacgacucgcccga

SEQ ID NO: 9927 - RNA, 51 nt, Artificial Sequence
  Description of Artificial Sequence: Synthetic oligonucleotide
gggaggacgaugcggauuggaggagggagggaccgcagacgacucgcccga

SEQ ID NO: 9928 - RNA, 51 nt, Artificial Sequence
  Description of Artificial Sequence: Synthetic oligonucleotide
gggaggacgaugcggauugguggggggagggacugcagacgacucgcccga

SEQ ID NO: 9929 - RNA, 51 nt, Artificial Sequence
  Description of Artificial Sequence: Synthetic oligonucleotide
gggaggacgaugcgggauucaaggccccgcgugugcagacgacucgcccga

SEQ ID NO: 9930 - RNA, 51 nt, Artificial Sequence
  Description of Artificial Sequence: Synthetic oligonucleotide
gggaggacgaugcggugcagggagguaguuaucgucagacgacucgcccga

SEQ ID NO: 9931 - RNA, 51 nt, Artificial Sequence
  Description of Artificial Sequence: Synthetic oligonucleotide
gggaggacgaugcgguuuggaguggggugguaccgcagacgacucgcccga

SEQ ID NO: 9932 - RNA, 51 nt, Artificial Sequence
  Description of Artificial Sequence: Synthetic oligonucleotide
gggaggacgaugcggauucgugcucauuccgcccccagacgacucgcccga

SEQ ID NO: 9933 - RNA, 51 nt, Artificial Sequence
  Description of Artificial Sequence: Synthetic oligonucleotide
gggaggacgaugcgguguagggugguaguuaucgucagacgacucgcccga

SEQ ID NO: 9934 - RNA, 51 nt, Artificial Sequence
  Description of Artificial Sequence: Synthetic oligonucleotide
gggaggacgaugcggaguucacaaaucaucugcugcagacgacucgcccga

SEQ ID NO: 9935 - RNA, 51 nt, Artificial Sequence
  Description of Artificial Sequence: Synthetic oligonucleotide
gggaggacgaugcggugacucgucuguuucguacccagacgacucgcccga

SEQ ID NO: 9936 - RNA, 51 nt, Artificial Sequence
  Description of Artificial Sequence: Synthetic oligonucleotide
gggaggacgaugcgguuggaaguaggaugggaccgcagacgacucgcccga

SEQ ID NO: 9937 - RNA, 52 nt, Artificial Sequence
  Description of Artificial Sequence: Synthetic oligonucleotide
gggaggacgaugcgguuugaagggugauggguccgccagacgacucgcccga

SEQ ID NO: 9938 - RNA, 51 nt, Artificial Sequence
  Description of Artificial Sequence: Synthetic oligonucleotide
gggaggacgaugcgguuggguguagggcgcuaccgcagacgacucgcccga

SEQ ID NO: 9939 - RNA, 49 nt, Artificial Sequence
  Description of Artificial Sequence: Synthetic oligonucleotide
gggaggacgaugcgguuggguagggugguacugcagacgacucgcccga

SEQ ID NO: 9940 - RNA, 52 nt, Artificial Sequence
  Description of Artificial Sequence: Synthetic oligonucleotide
gggaggacgaugcgguuugaagggugauggguccggcagacgacucgcccga

SEQ ID NO: 9941 - RNA, 51 nt, Artificial Sequence
  Description of Artificial Sequence: Synthetic oligonucleotide
gggaggacgaugcgguuggguguagggagguaccccagacgacucgcccga

SEQ ID NO: 9942 - RNA, 51 nt, Artificial Sequence
  Description of Artificial Sequence: Synthetic oligonucleotide
gggaggacgaugcgguuugaagguugaugguuccgcagacgacucgcccga

SEQ ID NO: 9943 - RNA, 51 nt, Artificial Sequence
  Description of Artificial Sequence: Synthetic oligonucleotide
gggaggacgaugcgguuugaagggggauggguccacagacgacucgcccga

SEQ ID NO: 9944 - RNA, 51 nt, Artificial Sequence
  Description of Artificial Sequence: Synthetic oligonucleotide
gggaggacgaugcgguuugaagcgcgauggguccgcagacgacucgcccga

SEQ ID NO: 9945 - RNA, 51 nt, Artificial Sequence
  Description of Artificial Sequence: Synthetic oligonucleotide
gggaggacgaugcgguuugcagggugguggguccgcagacgacucgcccga

SEQ ID NO: 9946 - RNA, 51 nt, Artificial Sequence
  Description of Artificial Sequence: Synthetic oligonucleotide
gggaggacgaugcggauuggaggggggagggacugcagacgacucgcccga

SEQ ID NO: 9947 - RNA, 51 nt, Artificial Sequence
  Description of Artificial Sequence: Synthetic oligonucleotide
gggaggacgaugcgguugggagggugauggguccgcagacgacucgcccga

SEQ ID NO: 9948 - RNA, 51 nt, Artificial Sequence
  Description of Artificial Sequence: Synthetic oligonucleotide
gggaggacgaugcgguuugcagggugcuggguccgcagacgacucgcccga

SEQ ID NO: 9949 - RNA, 51 nt, Artificial Sequence
  Description of Artificial Sequence: Synthetic oligonucleotide
gggaggacgaugcgguuugaaggguguuggguccccagacgacucgcccga

SEQ ID NO: 9950 - RNA, 52 nt, Artificial Sequence
  Description of Artificial Sequence: Synthetic oligonucleotide
gggaggacgaugcgguuuggguguagggugguaccucagacgacucgcccga

SEQ ID NO: 9951 - RNA, 51 nt, Artificial Sequence
  Description of Artificial Sequence: Synthetic oligonucleotide
gggaggacgaugcggugucggaggaggagguaccgcagacgacucgcccga

SEQ ID NO: 9952 - RNA, 51 nt, Artificial Sequence
  Description of Artificial Sequence: Synthetic oligonucleotide
gggaggacgaugcggucaucguuguccuugguccccagacgacucgcccga

SEQ ID NO: 9953 - RNA, 51 nt, Artificial Sequence
  Description of Artificial Sequence: Synthetic oligonucleotide
gggaggacgaugcggccacugcaagaauggugcugcagacgacucgcccga

SEQ ID NO: 9954 - RNA, 51 nt, Artificial Sequence
  Description of Artificial Sequence: Synthetic oligonucleotide
gggaggacgaugcggcuugucgucuuggucguccccagacgacucgcccga

SEQ ID NO: 9955 - RNA, 51 nt, Artificial Sequence
  Description of Artificial Sequence: Synthetic oligonucleotide
gggaggacgaugcggguugaaguguccguacugugcagacgacucgcccga

SEQ ID NO: 9956 - RNA, 51 nt, Artificial Sequence
  Description of Artificial Sequence: Synthetic oligonucleotide
gggaggacgaugcggagaguuucgucagccgugugcagacgacucgcccga

SEQ ID NO: 9957 - RNA, 51 nt, Artificial Sequence
  Description of Artificial Sequence: Synthetic oligonucleotide
gggaggacgaugcgggaguccgucaauguuguguccagacgacucgcccga

SEQ ID NO: 9958 - RNA, 51 nt, Artificial Sequence
  Description of Artificial Sequence: Synthetic oligonucleotide
gggaggacgaugcggaccgaacacaauaaguaccgcagacgacucgcccga

SEQ ID NO: 9959 - RNA, 51 nt, Artificial Sequence
  Description of Artificial Sequence: Synthetic oligonucleotide
gggaggacgaugcgggugugccgauuuggcauggccagacgacucgcccga

SEQ ID NO: 9960 - RNA, 51 nt, Artificial Sequence
  Description of Artificial Sequence: Synthetic oligonucleotide
gggaggacgaugcggcgaaucguacuaccgugcaccagacgacucgcccga

SEQ ID NO: 9961 - RNA, 51 nt, Artificial Sequence
  Description of Artificial Sequence: Synthetic oligonucleotide
gggaggacgaugcggccaucaauguaaggggugaccagacgacucgcccga

SEQ ID NO: 9962 - RNA, 51 nt, Artificial Sequence
  Description of Artificial Sequence: Synthetic oligonucleotide
gggaggacgaugcggaacgagaagucuacuccccccagacgacucgcccga

SEQ ID NO: 9963 - RNA, 51 nt, Artificial Sequence
  Description of Artificial Sequence: Synthetic oligonucleotide
gggaggacgaugcggugucguaguggcguuguggccagacgacucgcccga

SEQ ID NO: 9964 - RNA, 51 nt, Artificial Sequence
  Description of Artificial Sequence: Synthetic oligonucleotide
gggaggacgaugcggagucgugguucccgcgucaucagacgacucgcccga

SEQ ID NO: 9965 - RNA, 51 nt, Artificial Sequence
  Description of Artificial Sequence: Synthetic oligonucleotide
gggaggacgaugcggaccagccaguacagcgcugccagacgacucgcccga

SEQ ID NO: 9966 - RNA, 51 nt, Artificial Sequence
  Description of Artificial Sequence: Synthetic oligonucleotide
gggaggacgaugcgguuugaagggugguggcuccgcagacgacucgcccga

SEQ ID NO: 9967 - RNA, 51 nt, Artificial Sequence
  Description of Artificial Sequence: Synthetic oligonucleotide
gggaggacgaugcggucgguacaguugcucugcugcagacgacucgcccga

SEQ ID NO: 9968 - RNA, 51 nt, Artificial Sequence
  Description of Artificial Sequence: Synthetic oligonucleotide
gggaggacgaugcggucuccgaugcauguagccgucagacgacucgcccga

SEQ ID NO: 9969 - RNA, 50 nt, Artificial Sequence
  Description of Artificial Sequence: Synthetic oligonucleotide
gggaggacgaugcggauguaugugggagccacgccagacgacucgcccga

SEQ ID NO: 9970 - RNA, 51 nt, Artificial Sequence
  Description of Artificial Sequence: Synthetic oligonucleotide
gggaggacgaugcggagcuguaauucaugucugugcagacgacucgcccga

SEQ ID NO: 9971 - RNA, 51 nt, Artificial Sequence
  Description of Artificial Sequence: Synthetic oligonucleotide
gggaggacgaugcgguucuucucccaacguguguacagacgacucgcccga

SEQ ID NO: 9972 - RNA, 51 nt, Artificial Sequence
  Description of Artificial Sequence: Synthetic oligonucleotide
gggaggacgaugcggaaccccuuccucgucucguccagacgacucgcccga

SEQ ID NO: 9973 - RNA, 51 nt, Artificial Sequence
  Description of Artificial Sequence: Synthetic oligonucleotide
gggaggacgaugcggcuucaacaccucuucgucugcagacgacucgcccga

SEQ ID NO: 9974 - RNA, 51 nt, Artificial Sequence
  Description of Artificial Sequence: Synthetic oligonucleotide
gggaggacgaugcggcauacgucuaacccgugccccagacgacucgcccga

SEQ ID NO: 9975 - RNA, 51 nt, Artificial Sequence
  Description of Artificial Sequence: Synthetic oligonucleotide
gggaggacgaugcggcacuaagguugaccgguauccagacgacucgcccga

SEQ ID NO: 9976 - RNA, 51 nt, Artificial Sequence
  Description of Artificial Sequence: Synthetic oligonucleotide
gggaggacgaugcggauuucuaccuauagcuucugcagacgacucgcccga

SEQ ID NO: 9977 - RNA, 51 nt, Artificial Sequence
  Description of Artificial Sequence: Synthetic oligonucleotide
gggaggacgaugcggucugaagggugauggguccccagacgacucgcccga

SEQ ID NO: 9978 - RNA, 51 nt, Artificial Sequence
  Description of Artificial Sequence: Synthetic oligonucleotide
gggaggacgaugcggcuuggcgucuuguucguccccagacgacucgcccga

SEQ ID NO: 9979 - RNA, 51 nt, Artificial Sequence
  Description of Artificial Sequence: Synthetic oligonucleotide
gggaggacgaugcggauagggagaagugugaaccgcagacgacucgcccga

SEQ ID NO: 9980 - RNA, 51 nt, Artificial Sequence
  Description of Artificial Sequence: Synthetic oligonucleotide
gggaggacgaugcgguaaucuguccaacgcgugcccagacgacucgcccga

SEQ ID NO: 9981 - RNA, 51 nt, Artificial Sequence
  Description of Artificial Sequence: Synthetic oligonucleotide
gggaggacgaugcggauccggcauuccuccgugugcagacgacucgcccga

SEQ ID NO: 9982 - RNA, 51 nt, Artificial Sequence
  Description of Artificial Sequence: Synthetic oligonucleotide
gggaggacgaugcggauuggugaggggagggaccgcagacgacucgcccga

SEQ ID NO: 9983 - RNA, 51 nt, Artificial Sequence
  Description of Artificial Sequence: Synthetic oligonucleotide
gggaggacgaugcggccaaugaauccuguaccgcacagacgacucgcccga

SEQ ID NO: 9984 - RNA, 51 nt, Artificial Sequence
  Description of Artificial Sequence: Synthetic oligonucleotide
gggaggacgaugcgguuggguguaggguggaacugcagacgacucgcccga

SEQ ID NO: 9985 - RNA, 51 nt, Artificial Sequence
  Description of Artificial Sequence: Synthetic oligonucleotide
gggaggacgaugcgguuucucccacgcuguguugccagacgacucgcccga

SEQ ID NO: 9986 - RNA, 51 nt, Artificial Sequence
  Description of Artificial Sequence: Synthetic oligonucleotide
gggaggacgaugcgggguucuacuggucaccgugccagacgacucgcccga

SEQ ID NO: 9987 - RNA, 51 nt, Artificial Sequence
  Description of Artificial Sequence: Synthetic oligonucleotide
gggaggacgaugcggacuuuugcgauauguagccgcagacgacucgcccga

SEQ ID NO: 9988 - RNA, 51 nt, Artificial Sequence
  Description of Artificial Sequence: Synthetic oligonucleotide
gggaggacgaugcggaucggguagccguccagugccagacgacucgcccga

SEQ ID NO: 9989 - RNA, 51 nt, Artificial Sequence
  Description of Artificial Sequence: Synthetic oligonucleotide
gggaggacgaugcggucgcauucgauuguuccccccagacgacucgcccga

SEQ ID NO: 9990 - RNA, 51 nt, Artificial Sequence
  Description of Artificial Sequence: Synthetic oligonucleotide
gggaggacgaugcggucuagucuuggauggugcgccagacgacucgcccga

SEQ ID NO: 9991 - RNA, 51 nt, Artificial Sequence
  Description of Artificial Sequence: Synthetic oligonucleotide
gggaggacgaugcggguugaacgggcaaccuaccccagacgacucgcccga

SEQ ID NO: 9992 - RNA, 51 nt, Artificial Sequence
  Description of Artificial Sequence: Synthetic oligonucleotide
gggaggacgaugcggaucgcaugucugucgcugcccagacgacucgcccga

SEQ ID NO: 9993 - RNA, 51 nt, Artificial Sequence
  Description of Artificial Sequence: Synthetic oligonucleotide
gggaggacgaugcggauuaaugaagggagguacugcagacgacucgcccga

SEQ ID NO: 9994 - RNA, 51 nt, Artificial Sequence
  Description of Artificial Sequence: Synthetic oligonucleotide
gggaggacgaugcggugagaacuccacgugcgcuccagacgacucgcccga

SEQ ID NO: 9995 - RNA, 51 nt, Artificial Sequence
  Description of Artificial Sequence: Synthetic oligonucleotide
gggaggacgaugcggauguccccaucuucgucccccagacgacucgcccga

SEQ ID NO: 9996 - RNA, 51 nt, Artificial Sequence
  Description of Artificial Sequence: Synthetic oligonucleotide
gggaggacgaugcggcauugugcucguuuugcccccagacgacucgcccga

SEQ ID NO: 9997 - RNA, 51 nt, Artificial Sequence
  Description of Artificial Sequence: Synthetic oligonucleotide
gggaggacgaugcggaucguguggcuguguguggccagacgacucgcccga

SEQ ID NO: 9998 - RNA, 51 nt, Artificial Sequence
  Description of Artificial Sequence: Synthetic oligonucleotide
gggaggacgaugcgguaucacucaaagucugccgccagacgacucgcccga

SEQ ID NO: 9999 - RNA, 51 nt, Artificial Sequence
  Description of Artificial Sequence: Synthetic oligonucleotide
gggaggacgaugcggugcaugcuagaacaugugugcagacgacucgcccga

SEQ ID NO: 10000 - RNA, 51 nt, Artificial Sequence
  Description of Artificial Sequence: Synthetic oligonucleotide
gggaggacgaugcgguuguccugcauaacugugcccagacgacucgcccga

SEQ ID NO: 10001 - RNA, 51 nt, Artificial Sequence
  Description of Artificial Sequence: Synthetic oligonucleotide
gggaggacgaugcggcuccccaugagugucuugugcagacgacucgcccga

SEQ ID NO: 10002 - RNA, 51 nt, Artificial Sequence
  Description of Artificial Sequence: Synthetic oligonucleotide
gggaggacgaugcggacgagagccaucuguaggugcagacgacucgcccga

SEQ ID NO: 10003 - RNA, 51 nt, Artificial Sequence
  Description of Artificial Sequence: Synthetic oligonucleotide
gggaggacgaugcggguauguaaucugccguucugcagacgacucgcccga

SEQ ID NO: 10004 - RNA, 51 nt, Artificial Sequence
  Description of Artificial Sequence: Synthetic oligonucleotide
gggaggacgaugcgggacgacgaguuugccgcaugcagacgacucgcccga

SEQ ID NO: 10005 - RNA, 51 nt, Artificial Sequence
  Description of Artificial Sequence: Synthetic oligonucleotide
gggaggacgaugcggcuugguguagggugguaccgcagacgacucgcccga

SEQ ID NO: 10006 - RNA, 51 nt, Artificial Sequence
  Description of Artificial Sequence: Synthetic oligonucleotide
gggaggacgaugcgguguaggaggaggaggucccgcagacgacucgcccga

SEQ ID NO: 10007 - RNA, 51 nt, Artificial Sequence
  Description of Artificial Sequence: Synthetic oligonucleotide
gggaggacgaugcggaucgucgagugaucugcccgcagacgacucgcccga

SEQ ID NO: 10008 - RNA, 51 nt, Artificial Sequence
  Description of Artificial Sequence: Synthetic oligonucleotide
gggaggacgaugcggcugcacaaaauaggcugcaccagacgacucgcccga

SEQ ID NO: 10009 - RNA, 51 nt, Artificial Sequence
  Description of Artificial Sequence: Synthetic oligonucleotide
gggaggacgaugcggauugcugggauuuuuggccgcagacgacucgcccga

SEQ ID NO: 10010 - RNA, 51 nt, Artificial Sequence
  Description of Artificial Sequence: Synthetic oligonucleotide
gggaggacgaugcggugucuaguaauuggugucugcagacgacucgcccga

SEQ ID NO: 10011 - RNA, 51 nt, Artificial Sequence
  Description of Artificial Sequence: Synthetic oligonucleotide
gggaggacgaugcggaaacuccgucuuccacgcgccagacgacucgcccga

SEQ ID NO: 10012 - RNA, 51 nt, Artificial Sequence
  Description of Artificial Sequence: Synthetic oligonucleotide
gggaggacgaugcggaaguguccucuuacuggugccagacgacucgcccga

SEQ ID NO: 10013 - RNA, 51 nt, Artificial Sequence
  Description of Artificial Sequence: Synthetic oligonucleotide
gggaggacgaugcggucccccaaugucgcuguggccagacgacucgcccga

SEQ ID NO: 10014 - RNA, 51 nt, Artificial Sequence
  Description of Artificial Sequence: Synthetic oligonucleotide
gggaggacgaugcggguugaagagugauggguccgcagacgacucgcccga

SEQ ID NO: 10015 - RNA, 51 nt, Artificial Sequence
  Description of Artificial Sequence: Synthetic oligonucleotide
gggaggacgaugcgguuucgcuauuccugacucgccagacgacucgcccga

SEQ ID NO: 10016 - RNA, 51 nt, Artificial Sequence
  Description of Artificial Sequence: Synthetic oligonucleotide
gggaggacgaugcggcgagcaucugucaacgguaccagacgacucgcccga

SEQ ID NO: 10017 - RNA, 51 nt, Artificial Sequence
  Description of Artificial Sequence: Synthetic oligonucleotide
gggaggacgaugcggaucaucauccuuugcguggccagacgacucgcccga

SEQ ID NO: 10018 - RNA, 51 nt, Artificial Sequence
  Description of Artificial Sequence: Synthetic oligonucleotide
gggaggacgaugcggugacuccacuguacuguccccagacgacucgcccga

SEQ ID NO: 10019 - RNA, 51 nt, Artificial Sequence
  Description of Artificial Sequence: Synthetic oligonucleotide
gggaggacgaugcggcaacguccaaaauguagguccagacgacucgcccga

SEQ ID NO: 10020 - RNA, 51 nt, Artificial Sequence
  Description of Artificial Sequence: Synthetic oligonucleotide
gggaggacgaugcgggacgagcauaccacgguccccagacgacucgcccga

SEQ ID NO: 10021 - RNA, 51 nt, Artificial Sequence
  Description of Artificial Sequence: Synthetic oligonucleotide
gggaggacgaugcgguucuccacacgacucgucugcagacgacucgcccga

SEQ ID NO: 10022 - RNA, 51 nt, Artificial Sequence
  Description of Artificial Sequence: Synthetic oligonucleotide
gggaggacgaugcggcaaucgucuguuguuggugccagacgacucgcccga

SEQ ID NO: 10023 - RNA, 51 nt, Artificial Sequence
  Description of Artificial Sequence: Synthetic oligonucleotide
gggaggacgaugcggaauacggacgaauccucguacagacgacucgcccga

SEQ ID NO: 10024 - RNA, 51 nt, Artificial Sequence
  Description of Artificial Sequence: Synthetic oligonucleotide
gggaggacgaugcggagucugucuguacaaugcugcagacgacucgcccga

SEQ ID NO: 10025 - RNA, 51 nt, Artificial Sequence
  Description of Artificial Sequence: Synthetic oligonucleotide
gggaggacgaugcggcuaucagucaacguggugcccagacgacucgcccga

SEQ ID NO: 10026 - RNA, 51 nt, Artificial Sequence
  Description of Artificial Sequence: Synthetic oligonucleotide
gggaggacgaugcggaagaugaucgucacaguaugcagacgacucgcccga

SEQ ID NO: 10027 - RNA, 51 nt, Artificial Sequence
  Description of Artificial Sequence: Synthetic oligonucleotide
gggaggacgaugcggguucggucugauuccucccccagacgacucgcccga

SEQ ID NO: 10028 - RNA, 51 nt, Artificial Sequence
  Description of Artificial Sequence: Synthetic oligonucleotide
gggaggacgaugcgguaucuacuuauugaagugcccagacgacucgcccga

SEQ ID NO: 10029 - RNA, 51 nt, Artificial Sequence
  Description of Artificial Sequence: Synthetic oligonucleotide
gggaggacgaugcggugucuuggaaaacugguccgcagacgacucgcccga

SEQ ID NO: 10030 - RNA, 51 nt, Artificial Sequence
  Description of Artificial Sequence: Synthetic oligonucleotide
gggaggacgaugcggacaagcuguaacaccgcgugcagacgacucgcccga

SEQ ID NO: 10031 - RNA, 51 nt, Artificial Sequence
  Description of Artificial Sequence: Synthetic oligonucleotide
gggaggacgaugcggcagucauccaucuggucguacagacgacucgcccga

SEQ ID NO: 10032 - RNA, 51 nt, Artificial Sequence
  Description of Artificial Sequence: Synthetic oligonucleotide
gggaggacgaugcggauugucuguggugcuagccccagacgacucgcccga

SEQ ID NO: 10033 - RNA, 51 nt, Artificial Sequence
  Description of Artificial Sequence: Synthetic oligonucleotide
gggaggacgaugcggcugugaggagcaggguggugcagacgacucgcccga

SEQ ID NO: 10034 - RNA, 51 nt, Artificial Sequence
  Description of Artificial Sequence: Synthetic oligonucleotide
gggaggacgaugcgguauuggagguguagggacagcagacgacucgcccga

SEQ ID NO: 10035 - RNA, 51 nt, Artificial Sequence
  Description of Artificial Sequence: Synthetic oligonucleotide
gggaggacgaugcgggagauuguacgggugugccccagacgacucgcccga

SEQ ID NO: 10036 - RNA, 51 nt, Artificial Sequence
  Description of Artificial Sequence: Synthetic oligonucleotide
gggaggacgaugcggaucgugauggaugccgugcccagacgacucgcccga

SEQ ID NO: 10037 - RNA, 51 nt, Artificial Sequence
  Description of Artificial Sequence: Synthetic oligonucleotide
gggaggacgaugcggucugaagggggauggguccgcagacgacucgcccga

SEQ ID NO: 10038 - RNA, 51 nt, Artificial Sequence
  Description of Artificial Sequence: Synthetic oligonucleotide
gggaggacgaugcgguugggugucgggcgguaccgcagacgacucgcccga

SEQ ID NO: 10039 - RNA, 51 nt, Artificial Sequence
  Description of Artificial Sequence: Synthetic oligonucleotide
gggaggacgaugcgguuucguuccucugugcgcugcagacgacucgcccga

SEQ ID NO: 10040 - RNA, 51 nt, Artificial Sequence
  Description of Artificial Sequence: Synthetic oligonucleotide
gggaggacgaugcgguuuuaaggguuauggguccgcagacgacucgcccga

SEQ ID NO: 10041 - RNA, 51 nt, Artificial Sequence
  Description of Artificial Sequence: Synthetic oligonucleotide
gggaggacgaugcgguuggguguagguggguaccgcagacgacucgcccga

SEQ ID NO: 10042 - RNA, 51 nt, Artificial Sequence
  Description of Artificial Sequence: Synthetic oligonucleotide
gggaggacgaugcgguuugaaguagggugguaccgcagacgacucgcccga

SEQ ID NO: 10043 - RNA, 51 nt, Artificial Sequence
  Description of Artificial Sequence: Synthetic oligonucleotide
gggaggacgaugcgguauuggagguguagggaucgcagacgacucgcccga

SEQ ID NO: 10044 - RNA, 51 nt, Artificial Sequence
  Description of Artificial Sequence: Synthetic oligonucleotide
gggaggacgaugcgguugggagaagggugguaccgcagacgacucgcccga

SEQ ID NO: 10045 - RNA, 51 nt, Artificial Sequence
  Description of Artificial Sequence: Synthetic oligonucleotide
gggaggacgaugcggccguuuaaccguccuguccccagacgacucgcccga

SEQ ID NO: 10046 - RNA, 51 nt, Artificial Sequence
  Description of Artificial Sequence: Synthetic oligonucleotide
gggaggacgaugcggauuggagggugauggguccgcagacgacucgcccga

SEQ ID NO: 10047 - RNA, 51 nt, Artificial Sequence
  Description of Artificial Sequence: Synthetic oligonucleotide
gggaggacgaugcgguuagucguuguuugccugugcagacgacucgcccga

SEQ ID NO: 10048 - RNA, 51 nt, Artificial Sequence
  Description of Artificial Sequence: Synthetic oligonucleotide
gggaggacgaugcgguuuguucuccuuuggcucaccagacgacucgcccga

SEQ ID NO: 10049 - RNA, 51 nt, Artificial Sequence
  Description of Artificial Sequence: Synthetic oligonucleotide
gggaggacgaugcggugacucgucuguuucauccccagacgacucgcccga

SEQ ID NO: 10050 - RNA, 51 nt, Artificial Sequence
  Description of Artificial Sequence: Synthetic oligonucleotide
gggaggacgaugcgguggcucgauguccuguaccccagacgacucgcccga

SEQ ID NO: 10051 - RNA, 51 nt, Artificial Sequence
  Description of Artificial Sequence: Synthetic oligonucleotide
gggaggacgaugcggaucguuuggcuguugugcaccagacgacucgcccga

SEQ ID NO: 10052 - RNA, 51 nt, Artificial Sequence
  Description of Artificial Sequence: Synthetic oligonucleotide
gggaggacgaugcgguccuugucgucuuguguccccagacgacucgcccga

SEQ ID NO: 10053 - RNA, 51 nt, Artificial Sequence
  Description of Artificial Sequence: Synthetic oligonucleotide
gggaggacgaugcggucuggcgaacauagacugcccagacgacucgcccga

SEQ ID NO: 10054 - RNA, 51 nt, Artificial Sequence
  Description of Artificial Sequence: Synthetic oligonucleotide
gggaggacgaugcggcauaguagacuugaccuccccagacgacucgcccga

SEQ ID NO: 10055 - RNA, 51 nt, Artificial Sequence
  Description of Artificial Sequence: Synthetic oligonucleotide
gggaggacgaugcggcaguugucuucacucccccccagacgacucgcccga

SEQ ID NO: 10056 - RNA, 51 nt, Artificial Sequence
  Description of Artificial Sequence: Synthetic oligonucleotide
gggaggacgaugcggcaagugaacgucugagcccccagacgacucgcccga

SEQ ID NO: 10057 - RNA, 51 nt, Artificial Sequence
  Description of Artificial Sequence: Synthetic oligonucleotide
gggaggacgaugcggaccgcacgucuuuaugucgucagacgacucgcccga

SEQ ID NO: 10058 - RNA, 51 nt, Artificial Sequence
  Description of Artificial Sequence: Synthetic oligonucleotide
gggaggacgaugcggauauuguaggucugcaugugcagacgacucgcccga

SEQ ID NO: 10059 - RNA, 51 nt, Artificial Sequence
  Description of Artificial Sequence: Synthetic oligonucleotide
gggaggacgaugcgguguucgcgugugcuuuugcccagacgacucgcccga

SEQ ID NO: 10060 - RNA, 51 nt, Artificial Sequence
  Description of Artificial Sequence: Synthetic oligonucleotide
gggaggacgaugcggagaugccgcccuuccgugugcagacgacucgcccga

SEQ ID NO: 10061 - RNA, 51 nt, Artificial Sequence
  Description of Artificial Sequence: Synthetic oligonucleotide
gggaggacgaugcggugcuuggacuuaugucgguacagacgacucgcccga

SEQ ID NO: 10062 - RNA, 51 nt, Artificial Sequence
  Description of Artificial Sequence: Synthetic oligonucleotide
gggaggacgaugcgguaacauuccuaugcgcucugcagacgacucgcccga

SEQ ID NO: 10063 - RNA, 51 nt, Artificial Sequence
  Description of Artificial Sequence: Synthetic oligonucleotide
gggaggacgaugcggugaacguaaaaguucaugugcagacgacucgcccga

SEQ ID NO: 10064 - RNA, 51 nt, Artificial Sequence
  Description of Artificial Sequence: Synthetic oligonucleotide
gggaggacgaugcgguugucuaguuugggugcuaccagacgacucgcccga

SEQ ID NO: 10065 - RNA, 51 nt, Artificial Sequence
  Description of Artificial Sequence: Synthetic oligonucleotide
gggaggacgaugcggaugcccgacgaugucccguacagacgacucgcccga

SEQ ID NO: 10066 - RNA, 51 nt, Artificial Sequence
  Description of Artificial Sequence: Synthetic oligonucleotide
gggaggacgaugcgggaccgugucaggauugcccucagacgacucgcccga

SEQ ID NO: 10067 - RNA, 51 nt, Artificial Sequence
  Description of Artificial Sequence: Synthetic oligonucleotide
gggaggacgaugcgguuugaaggguaauggguccccagacgacucgcccga

SEQ ID NO: 10068 - RNA, 51 nt, Artificial Sequence
  Description of Artificial Sequence: Synthetic oligonucleotide
gggaggacgaugcgguaaguagucuguaugcgguccagacgacucgcccga

SEQ ID NO: 10069 - RNA, 51 nt, Artificial Sequence
  Description of Artificial Sequence: Synthetic oligonucleotide
gggaggacgaugcggucucccacaaaguuuggcugcagacgacucgcccga

SEQ ID NO: 10070 - RNA, 51 nt, Artificial Sequence
  Description of Artificial Sequence: Synthetic oligonucleotide
gggaggacgaugcggcacgucuuaauuuccccccccagacgacucgcccga

SEQ ID NO: 10071 - RNA, 51 nt, Artificial Sequence
  Description of Artificial Sequence: Synthetic oligonucleotide
gggaggacgaugcgguaacauacgucuggccgcugcagacgacucgcccga

SEQ ID NO: 10072 - RNA, 51 nt, Artificial Sequence
  Description of Artificial Sequence: Synthetic oligonucleotide
gggaggacgaugcgguuugaagggugaugggugggcagacgacucgcccga

SEQ ID NO: 10073 - RNA, 51 nt, Artificial Sequence
  Description of Artificial Sequence: Synthetic oligonucleotide
gggaggacgaugcgguccccuucguuuugcugccgcagacgacucgcccga

SEQ ID NO: 10074 - RNA, 51 nt, Artificial Sequence
  Description of Artificial Sequence: Synthetic oligonucleotide
gggaggacgaugcggaucaggugcucugucguguacagacgacucgcccga

SEQ ID NO: 10075 - RNA, 51 nt, Artificial Sequence
  Description of Artificial Sequence: Synthetic oligonucleotide
gggaggacgaugcggccgcuucucguguuacccgccagacgacucgcccga

SEQ ID NO: 10076 - RNA, 51 nt, Artificial Sequence
  Description of Artificial Sequence: Synthetic oligonucleotide
gggaggacgaugcggcaucgacuguaguuuaugugcagacgacucgcccga

SEQ ID NO: 10077 - RNA, 51 nt, Artificial Sequence
  Description of Artificial Sequence: Synthetic oligonucleotide
gggaggacgaugcggagugucggaucugguguugccagacgacucgcccga

SEQ ID NO: 10078 - RNA, 51 nt, Artificial Sequence
  Description of Artificial Sequence: Synthetic oligonucleotide
gggaggacgaugcggcgauuguuggggaucugccccagacgacucgcccga

SEQ ID NO: 10079 - RNA, 51 nt, Artificial Sequence
  Description of Artificial Sequence: Synthetic oligonucleotide
gggaggacgaugcggaaucgcucccaauugcgugccagacgacucgcccga

SEQ ID NO: 10080 - RNA, 50 nt, Artificial Sequence
  Description of Artificial Sequence: Synthetic oligonucleotide
gggaggacgaugcgguaucauacgaauacgugugcagacgacucgcccga

SEQ ID NO: 10081 - RNA, 51 nt, Artificial Sequence
  Description of Artificial Sequence: Synthetic oligonucleotide
gggaggacgaugcggcaguaaggucggugcguguccagacgacucgcccga

SEQ ID NO: 10082 - RNA, 51 nt, Artificial Sequence
  Description of Artificial Sequence: Synthetic oligonucleotide
gggaggacgaugcggauccucguaauugccgcguacagacgacucgcccga

SEQ ID NO: 10083 - RNA, 51 nt, Artificial Sequence
  Description of Artificial Sequence: Synthetic oligonucleotide
gggaggacgaugcgguuuggugaagggggguacugcagacgacucgcccga

SEQ ID NO: 10084 - RNA, 50 nt, Artificial Sequence
  Description of Artificial Sequence: Synthetic oligonucleotide
gggaggacgaugcgguccuugucguuugcguccccagacgacucgcccga

SEQ ID NO: 10085 - RNA, 51 nt, Artificial Sequence
  Description of Artificial Sequence: Synthetic oligonucleotide
gggaggacgaugcggagagucugaugucaccugugcagacgacucgcccga

SEQ ID NO: 10086 - RNA, 51 nt, Artificial Sequence
  Description of Artificial Sequence: Synthetic oligonucleotide
gggaggacgaugcgggcgguacgaucuaaucuccccagacgacucgcccga

SEQ ID NO: 10087 - RNA, 51 nt, Artificial Sequence
  Description of Artificial Sequence: Synthetic oligonucleotide
gggaggacgaugcgggcagcgcuaguucucgugaccagacgacucgcccga

SEQ ID NO: 10088 - RNA, 51 nt, Artificial Sequence
  Description of Artificial Sequence: Synthetic oligonucleotide
gggaggacgaugcggaaugagucugaccgucacgccagacgacucgcccga

SEQ ID NO: 10089 - RNA, 51 nt, Artificial Sequence
  Description of Artificial Sequence: Synthetic oligonucleotide
gggaggacgaugcggguugaggggugauggguccgcagacgacucgcccga

SEQ ID NO: 10090 - RNA, 49 nt, Artificial Sequence
  Description of Artificial Sequence: Synthetic oligonucleotide
gggaggacgaugcgggccuuucguuccccuccccagacgacucgcccga

SEQ ID NO: 10091 - RNA, 51 nt, Artificial Sequence
  Description of Artificial Sequence: Synthetic oligonucleotide
gggaggacgaugcgguuugaaggguuaugggcccgcagacgacucgcccga

SEQ ID NO: 10092 - RNA, 51 nt, Artificial Sequence
  Description of Artificial Sequence: Synthetic oligonucleotide
gggaggacgaugcggguugguggagggagguacugcagacgacucgcccga

SEQ ID NO: 10093 - RNA, 51 nt, Artificial Sequence
  Description of Artificial Sequence: Synthetic oligonucleotide
gggaggacgaugcggaaugaauuaucuacauuccccagacgacucgcccga

SEQ ID NO: 10094 - RNA, 51 nt, Artificial Sequence
  Description of Artificial Sequence: Synthetic oligonucleotide
gggaggacgaugcggucaugcgauagucucccccccagacgacucgcccga

SEQ ID NO: 10095 - RNA, 51 nt, Artificial Sequence
  Description of Artificial Sequence: Synthetic oligonucleotide
gggaggacgaugcgguucuucccuuguugcggguacagacgacucgcccga

SEQ ID NO: 10096 - RNA, 50 nt, Artificial Sequence
  Description of Artificial Sequence: Synthetic oligonucleotide
gggaggacgaugcggcccgucgucuguucguccccagacgacucgcccga

SEQ ID NO: 10097 - RNA, 51 nt, Artificial Sequence
  Description of Artificial Sequence: Synthetic oligonucleotide
gggaggacgaugcggaacccugugcacaugccguacagacgacucgcccga

SEQ ID NO: 10098 - RNA, 51 nt, Artificial Sequence
  Description of Artificial Sequence: Synthetic oligonucleotide
gggaggacgaugcggauauacguacauggguggcccagacgacucgcccga

SEQ ID NO: 10099 - RNA, 51 nt, Artificial Sequence
  Description of Artificial Sequence: Synthetic oligonucleotide
gggaggacgaugcggguccugugcgccugugugaccagacgacucgcccga

SEQ ID NO: 10100 - RNA, 51 nt, Artificial Sequence
  Description of Artificial Sequence: Synthetic oligonucleotide
gggaggacgaugcgguaggugcaaauccacagccccagacgacucgcccga

SEQ ID NO: 10101 - RNA, 51 nt, Artificial Sequence
  Description of Artificial Sequence: Synthetic oligonucleotide
gggaggacgaugcggaaucuugaccccucgccaugcagacgacucgcccga

SEQ ID NO: 10102 - RNA, 51 nt, Artificial Sequence
  Description of Artificial Sequence: Synthetic oligonucleotide
gggaggacgaugcggaccguaucaucaugccgccacagacgacucgcccga

SEQ ID NO: 10103 - RNA, 51 nt, Artificial Sequence
  Description of Artificial Sequence: Synthetic oligonucleotide
gggaggacgaugcggauuggaggagggagguacugcagacgacucgcccga

SEQ ID NO: 10104 - RNA, 50 nt, Artificial Sequence
  Description of Artificial Sequence: Synthetic oligonucleotide
gggaggacgaugcggucugugugggauguugccccagacgacucgcccga

SEQ ID NO: 10105 - RNA, 51 nt, Artificial Sequence
  Description of Artificial Sequence: Synthetic oligonucleotide
gggaggacgaugcggccuaucgucauguucguggccagacgacucgcccga

SEQ ID NO: 10106 - RNA, 51 nt, Artificial Sequence
  Description of Artificial Sequence: Synthetic oligonucleotide
gggaggacgaugcggcauaggacaggguuguggcccagacgacucgcccga

SEQ ID NO: 10107 - RNA, 51 nt, Artificial Sequence
  Description of Artificial Sequence: Synthetic oligonucleotide
gggaggacgaugcggccuucauugucuucgcgguacagacgacucgcccga

SEQ ID NO: 10108 - RNA, 51 nt, Artificial Sequence
  Description of Artificial Sequence: Synthetic oligonucleotide
gggaggacgaugcgggcuauguguguucguugggccagacgacucgcccga

SEQ ID NO: 10109 - RNA, 51 nt, Artificial Sequence
  Description of Artificial Sequence: Synthetic oligonucleotide
gggaggacgaugcgguccuguugccccaugugugccagacgacucgcccga

SEQ ID NO: 10110 - RNA, 51 nt, Artificial Sequence
  Description of Artificial Sequence: Synthetic oligonucleotide
gggaggacgaugcggaccagcguauguacacuccccagacgacucgcccga

SEQ ID NO: 10111 - RNA, 51 nt, Artificial Sequence
  Description of Artificial Sequence: Synthetic oligonucleotide
gggaggacgaugcgguguaggagguguagggaccgcagacgacucgcccga

SEQ ID NO: 10112 - RNA, 51 nt, Artificial Sequence
  Description of Artificial Sequence: Synthetic oligonucleotide
gggaggacgaugcggguugaugcuggucacgaugccagacgacucgcccga

SEQ ID NO: 10113 - RNA, 51 nt, Artificial Sequence
  Description of Artificial Sequence: Synthetic oligonucleotide
gggaggacgaugcgguguccguucccgaucugugccagacgacucgcccga

SEQ ID NO: 10114 - RNA, 51 nt, Artificial Sequence
  Description of Artificial Sequence: Synthetic oligonucleotide
gggaggacgaugcggagugugagucguuguacccccagacgacucgcccga

SEQ ID NO: 10115 - RNA, 51 nt, Artificial Sequence
  Description of Artificial Sequence: Synthetic oligonucleotide
gggaggacgaugcggaguagcgccugcugacugcccagacgacucgcccga

SEQ ID NO: 10116 - RNA, 51 nt, Artificial Sequence
  Description of Artificial Sequence: Synthetic oligonucleotide
gggaggacgaugcgggugagcaucugaccccuguccagacgacucgcccga

SEQ ID NO: 10117 - RNA, 51 nt, Artificial Sequence
  Description of Artificial Sequence: Synthetic oligonucleotide
gggaggacgaugcgguauaauccugugccugaccccagacgacucgcccga

SEQ ID NO: 10118 - RNA, 51 nt, Artificial Sequence
  Description of Artificial Sequence: Synthetic oligonucleotide
gggaggacgaugcggggaaccucacaguauguccgcagacgacucgcccga

SEQ ID NO: 10119 - RNA, 51 nt, Artificial Sequence
  Description of Artificial Sequence: Synthetic oligonucleotide
gggaggacgaugcggguucacgauuagcgccuggccagacgacucgcccga

SEQ ID NO: 10120 - RNA, 51 nt, Artificial Sequence
  Description of Artificial Sequence: Synthetic oligonucleotide
gggaggacgaugcggcguauugucucgccagugugcagacgacucgcccga

SEQ ID NO: 10121 - RNA, 51 nt, Artificial Sequence
  Description of Artificial Sequence: Synthetic oligonucleotide
gggaggacgaugcgggugucuucugaguuuuggcccagacgacucgcccga

SEQ ID NO: 10122 - RNA, 51 nt, Artificial Sequence
  Description of Artificial Sequence: Synthetic oligonucleotide
gggaggacgaugcgguuugaagggggauggguucgcagacgacucgcccga

SEQ ID NO: 10123 - RNA, 51 nt, Artificial Sequence
  Description of Artificial Sequence: Synthetic oligonucleotide
gggaggacgaugcgguuugaagauugauggguccgcagacgacucgcccga

SEQ ID NO: 10124 - RNA, 51 nt, Artificial Sequence
  Description of Artificial Sequence: Synthetic oligonucleotide
gggaggacgaugcgguuugaaggcagauggguccgcagacgacucgcccga

SEQ ID NO: 10125 - RNA, 51 nt, Artificial Sequence
  Description of Artificial Sequence: Synthetic oligonucleotide
gggaggacgaugcgguuugaagggcgauggguacgcagacgacucgcccga

SEQ ID NO: 10126 - RNA, 51 nt, Artificial Sequence
  Description of Artificial Sequence: Synthetic oligonucleotide
gggaggacgaugcgguuuguggggugauggguccgcagacgacucgcccga

SEQ ID NO: 10127 - RNA, 51 nt, Artificial Sequence
  Description of Artificial Sequence: Synthetic oligonucleotide
gggaggacgaugcgguuggguguagggggguaccccagacgacucgcccga

SEQ ID NO: 10128 - RNA, 51 nt, Artificial Sequence
  Description of Artificial Sequence: Synthetic oligonucleotide
gggaggacgaugcggauugguggagggugguacugcagacgacucgcccga

SEQ ID NO: 10129 - RNA, 51 nt, Artificial Sequence
  Description of Artificial Sequence: Synthetic oligonucleotide
gggaggacgaugcggauuggugcagggaggcacugcagacgacucgcccga

SEQ ID NO: 10130 - RNA, 51 nt, Artificial Sequence
  Description of Artificial Sequence: Synthetic oligonucleotide
gggaggacgaugcgguuugaagggugauggggcggcagacgacucgcccga

SEQ ID NO: 10131 - RNA, 51 nt, Artificial Sequence
  Description of Artificial Sequence: Synthetic oligonucleotide
gggaggacgaugcggguggguguagggggguaccgcagacgacucgcccga

SEQ ID NO: 10132 - RNA, 51 nt, Artificial Sequence
  Description of Artificial Sequence: Synthetic oligonucleotide
gggaggacgaugcgguuugaagguugauggguccccagacgacucgcccga

SEQ ID NO: 10133 - RNA, 51 nt, Artificial Sequence
  Description of Artificial Sequence: Synthetic oligonucleotide
gggaggacgaugcgguuugaagggugguggguucgcagacgacucgcccga

SEQ ID NO: 10134 - RNA, 51 nt, Artificial Sequence
  Description of Artificial Sequence: Synthetic oligonucleotide
gggaggacgaugcgguuggguguagaaugguaccgcagacgacucgcccga

SEQ ID NO: 10135 - RNA, 51 nt, Artificial Sequence
  Description of Artificial Sequence: Synthetic oligonucleotide
gggaggacgaugcgguuugaacggagauggguccgcagacgacucgcccga

SEQ ID NO: 10136 - RNA, 51 nt, Artificial Sequence
  Description of Artificial Sequence: Synthetic oligonucleotide
gggaggacgaugcggaucgaaggauuuuugggcugcagacgacucgcccga

SEQ ID NO: 10137 - RNA, 52 nt, Artificial Sequence
  Description of Artificial Sequence: Synthetic oligonucleotide
gggaggacgaugcgguuugaagggugaugauguccgcagacgacucgcccga

SEQ ID NO: 10138 - RNA, 51 nt, Artificial Sequence
  Description of Artificial Sequence: Synthetic oligonucleotide
gggaggacgaugcgguauuugagguguagggaccgcagacgacucgcccga

SEQ ID NO: 10139 - RNA, 51 nt, Artificial Sequence
  Description of Artificial Sequence: Synthetic oligonucleotide
gggaggacgaugcgguguagggagguagcuaucgucagacgacucgcccga

SEQ ID NO: 10140 - RNA, 51 nt, Artificial Sequence
  Description of Artificial Sequence: Synthetic oligonucleotide
gggaggacgaugcgguuggguguagggcuguaccgcagacgacucgcccga

SEQ ID NO: 10141 - RNA, 51 nt, Artificial Sequence
  Description of Artificial Sequence: Synthetic oligonucleotide
gggaggacgaugcgguagccuucauuguugccccccagacgacucgcccga

SEQ ID NO: 10142 - RNA, 51 nt, Artificial Sequence
  Description of Artificial Sequence: Synthetic oligonucleotide
gggaggacgaugcggacagggagaagggugaaccgcagacgacucgcccga

SEQ ID NO: 10143 - RNA, 51 nt, Artificial Sequence
  Description of Artificial Sequence: Synthetic oligonucleotide
gggaggacgaugcgguuugaauggugaugggucugcagacgacucgcccga

SEQ ID NO: 10144 - RNA, 51 nt, Artificial Sequence
  Description of Artificial Sequence: Synthetic oligonucleotide
gggaggacgaugcgguccugucgucuuugcguucccagacgacucgcccga

SEQ ID NO: 10145 - RNA, 51 nt, Artificial Sequence
  Description of Artificial Sequence: Synthetic oligonucleotide
gggaggacgaugcggcgggguguagggugguaccgcagacgacucgcccga

SEQ ID NO: 10146 - RNA, 50 nt, Artificial Sequence
  Description of Artificial Sequence: Synthetic oligonucleotide
gggaggacgaugcggcuggugaagggagguacugcagacgacucgcccga

SEQ ID NO: 10147 - RNA, 51 nt, Artificial Sequence
  Description of Artificial Sequence: Synthetic oligonucleotide
gggaggacgaugcgguuugaagggugauugguccccagacgacucgcccga

SEQ ID NO: 10148 - RNA, 50 nt, Artificial Sequence
  Description of Artificial Sequence: Synthetic oligonucleotide
gggaggacgaugcgguugggugagggugguaccgcagacgacucgcccga

SEQ ID NO: 10149 - RNA, 51 nt, Artificial Sequence
  Description of Artificial Sequence: Synthetic oligonucleotide
gggaggacgaugcgggugacaaacuaggugggcgccagacgacucgcccga

SEQ ID NO: 10150 - RNA, 51 nt, Artificial Sequence
  Description of Artificial Sequence: Synthetic oligonucleotide
gggaggacgaugcggccaggucguucuacucaccccagacgacucgcccga

SEQ ID NO: 10151 - RNA, 51 nt, Artificial Sequence
  Description of Artificial Sequence: Synthetic oligonucleotide
gggaggacgaugcggugccgauuaagucugguugccagacgacucgcccga

SEQ ID NO: 10152 - RNA, 51 nt, Artificial Sequence
  Description of Artificial Sequence: Synthetic oligonucleotide
gggaggacgaugcggucagcuggagguugccccuacagacgacucgcccga

SEQ ID NO: 10153 - RNA, 51 nt, Artificial Sequence
  Description of Artificial Sequence: Synthetic oligonucleotide
gggaggacgaugcgggagguaaugucugggugcuccagacgacucgcccga

SEQ ID NO: 10154 - RNA, 51 nt, Artificial Sequence
  Description of Artificial Sequence: Synthetic oligonucleotide
gggaggacgaugcggcauccguugugucaugucggcagacgacucgcccga

SEQ ID NO: 10155 - RNA, 51 nt, Artificial Sequence
  Description of Artificial Sequence: Synthetic oligonucleotide
gggaggacgaugcggaucacuucgcaccuuguccccagacgacucgcccga

SEQ ID NO: 10156 - RNA, 51 nt, Artificial Sequence
  Description of Artificial Sequence: Synthetic oligonucleotide
gggaggacgaugcggaguuagcaucaucucguccgcagacgacucgcccga

SEQ ID NO: 10157 - RNA, 51 nt, Artificial Sequence
  Description of Artificial Sequence: Synthetic oligonucleotide
gggaggacgaugcggugagaugucuguuugccggccagacgacucgcccga

SEQ ID NO: 10158 - RNA, 51 nt, Artificial Sequence
  Description of Artificial Sequence: Synthetic oligonucleotide
gggaggacgaugcgggauccggaauccgucguguacagacgacucgcccga

SEQ ID NO: 10159 - RNA, 51 nt, Artificial Sequence
  Description of Artificial Sequence: Synthetic oligonucleotide
gggaggacgaugcggucccguucucucucguacgccagacgacucgcccga

SEQ ID NO: 10160 - RNA, 51 nt, Artificial Sequence
  Description of Artificial Sequence: Synthetic oligonucleotide
gggaggacgaugcgguaccgcguucauaucccggccagacgacucgcccga

SEQ ID NO: 10161 - RNA, 51 nt, Artificial Sequence
  Description of Artificial Sequence: Synthetic oligonucleotide
gggaggacgaugcggucgguguccacaguuguguacagacgacucgcccga

SEQ ID NO: 10162 - RNA, 51 nt, Artificial Sequence
  Description of Artificial Sequence: Synthetic oligonucleotide
gggaggacgaugcgguguggugaguaggcacugaccagacgacucgcccga

SEQ ID NO: 10163 - RNA, 51 nt, Artificial Sequence
  Description of Artificial Sequence: Synthetic oligonucleotide
gggaggacgaugcgguuugugcaauauucgucgugcagacgacucgcccga

SEQ ID NO: 10164 - RNA, 51 nt, Artificial Sequence
  Description of Artificial Sequence: Synthetic oligonucleotide
gggaggacgaugcggugagaucugacgacaugcgccagacgacucgcccga

SEQ ID NO: 10165 - RNA, 51 nt, Artificial Sequence
  Description of Artificial Sequence: Synthetic oligonucleotide
gggaggacgaugcggacgauguacugguuugccgccagacgacucgcccga

SEQ ID NO: 10166 - RNA, 51 nt, Artificial Sequence
  Description of Artificial Sequence: Synthetic oligonucleotide
gggaggacgaugcggauugcguaaccagcguuguacagacgacucgcccga

SEQ ID NO: 10167 - RNA, 51 nt, Artificial Sequence
  Description of Artificial Sequence: Synthetic oligonucleotide
gggaggacgaugcggcaauucgucuuacgccaccccagacgacucgcccga

SEQ ID NO: 10168 - RNA, 51 nt, Artificial Sequence
  Description of Artificial Sequence: Synthetic oligonucleotide
gggaggacgaugcggucagaguacuugagagcccccagacgacucgcccga

SEQ ID NO: 10169 - RNA, 51 nt, Artificial Sequence
  Description of Artificial Sequence: Synthetic oligonucleotide
gggaggacgaugcggugaguaagccuguguuuguccagacgacucgcccga

SEQ ID NO: 10170 - RNA, 51 nt, Artificial Sequence
  Description of Artificial Sequence: Synthetic oligonucleotide
gggaggacgaugcgggucgccaauacuuacggccgcagacgacucgcccga

SEQ ID NO: 10171 - RNA, 51 nt, Artificial Sequence
  Description of Artificial Sequence: Synthetic oligonucleotide
gggaggacgaugcggguuugguacugguuucccaccagacgacucgcccga

SEQ ID NO: 10172 - RNA, 51 nt, Artificial Sequence
  Description of Artificial Sequence: Synthetic oligonucleotide
gggaggacgaugcggaaacgacggugacguuacugcagacgacucgcccga

SEQ ID NO: 10173 - RNA, 51 nt, Artificial Sequence
  Description of Artificial Sequence: Synthetic oligonucleotide
gggaggacgaugcggcaccgcuuucguggucuccccagacgacucgcccga

SEQ ID NO: 10174 - RNA, 51 nt, Artificial Sequence
  Description of Artificial Sequence: Synthetic oligonucleotide
gggaggacgaugcggcaucaguuuuuucccgugugcagacgacucgcccga

SEQ ID NO: 10175 - RNA, 50 nt, Artificial Sequence
  Description of Artificial Sequence: Synthetic oligonucleotide
gggaggacgaugcgggugucucugguuggcggaccagacgacucgcccga

SEQ ID NO: 10176 - RNA, 51 nt, Artificial Sequence
  Description of Artificial Sequence: Synthetic oligonucleotide
gggaggacgaugcggagcgaauagggucaggugugcagacgacucgcccga

SEQ ID NO: 10177 - RNA, 51 nt, Artificial Sequence
  Description of Artificial Sequence: Synthetic oligonucleotide
gggaggacgaugcgguuucguuucuaacccgugugcagacgacucgcccga

SEQ ID NO: 10178 - RNA, 51 nt, Artificial Sequence
  Description of Artificial Sequence: Synthetic oligonucleotide
gggaggacgaugcggcaguuguaagguuaguuggccagacgacucgcccga

SEQ ID NO: 10179 - RNA, 51 nt, Artificial Sequence
  Description of Artificial Sequence: Synthetic oligonucleotide
gggaggacgaugcggccgccauaaucuucgcuccccagacgacucgcccga

SEQ ID NO: 10180 - RNA, 51 nt, Artificial Sequence
  Description of Artificial Sequence: Synthetic oligonucleotide
gggaggacgaugcgggaugacgugcuguugcgcgccagacgacucgcccga

SEQ ID NO: 10181 - RNA, 51 nt, Artificial Sequence
  Description of Artificial Sequence: Synthetic oligonucleotide
gggaggacgaugcggcugugguaauauucuguccgcagacgacucgcccga

SEQ ID NO: 10182 - RNA, 52 nt, Artificial Sequence
  Description of Artificial Sequence: Synthetic oligonucleotide
gggaggacgaugcgggccuuucguucugcccccccccagacgacucgcccga

SEQ ID NO: 10183 - RNA, 51 nt, Artificial Sequence
  Description of Artificial Sequence: Synthetic oligonucleotide
gggaggacgaugcggaagguguagagguguugugccagacgacucgcccga

SEQ ID NO: 10184 - RNA, 51 nt, Artificial Sequence
  Description of Artificial Sequence: Synthetic oligonucleotide
gggaggacgaugcggucaccugacguaaucagggccagacgacucgcccga

SEQ ID NO: 10185 - RNA, 51 nt, Artificial Sequence
  Description of Artificial Sequence: Synthetic oligonucleotide
gggaggacgaugcggcgacuguacgaguucccccccagacgacucgcccga

SEQ ID NO: 10186 - RNA, 51 nt, Artificial Sequence
  Description of Artificial Sequence: Synthetic oligonucleotide
gggaggacgaugcggguauaugcuccgcgauuggccagacgacucgcccga

SEQ ID NO: 10187 - RNA, 51 nt, Artificial Sequence
  Description of Artificial Sequence: Synthetic oligonucleotide
gggaggacgaugcggaucgacugugcuuucggggccagacgacucgcccga

SEQ ID NO: 10188 - RNA, 51 nt, Artificial Sequence
  Description of Artificial Sequence: Synthetic oligonucleotide
gggaggacgaugcggucccgagauuugugaguguccagacgacucgcccga

SEQ ID NO: 10189 - RNA, 51 nt, Artificial Sequence
  Description of Artificial Sequence: Synthetic oligonucleotide
gggaggacgaugcggugggucgucuccauggugcccagacgacucgcccga

SEQ ID NO: 10190 - RNA, 51 nt, Artificial Sequence
  Description of Artificial Sequence: Synthetic oligonucleotide
gggaggacgaugcggacgaucgucgucuacagcugcagacgacucgcccga

SEQ ID NO: 10191 - RNA, 51 nt, Artificial Sequence
  Description of Artificial Sequence: Synthetic oligonucleotide
gggaggacgaugcggaucuucuggcuuaucguccccagacgacucgcccga

SEQ ID NO: 10192 - RNA, 51 nt, Artificial Sequence
  Description of Artificial Sequence: Synthetic oligonucleotide
gggaggacgaugcggucccgcuuuucguugcaccccagacgacucgcccga

SEQ ID NO: 10193 - RNA, 51 nt, Artificial Sequence
  Description of Artificial Sequence: Synthetic oligonucleotide
gggaggacgaugcggaauaaccuccauacugugugcagacgacucgcccga

SEQ ID NO: 10194 - RNA, 51 nt, Artificial Sequence
  Description of Artificial Sequence: Synthetic oligonucleotide
gggaggacgaugcggaacguaaaccuccauacguccagacgacucgcccga

SEQ ID NO: 10195 - RNA, 51 nt, Artificial Sequence
  Description of Artificial Sequence: Synthetic oligonucleotide
gggaggacgaugcggguucguagugugcagggcugcagacgacucgcccga

SEQ ID NO: 10196 - RNA, 51 nt, Artificial Sequence
  Description of Artificial Sequence: Synthetic oligonucleotide
gggaggacgaugcggugaguuccuucggucugcgccagacgacucgcccga

SEQ ID NO: 10197 - RNA, 51 nt, Artificial Sequence
  Description of Artificial Sequence: Synthetic oligonucleotide
gggaggacgaugcggucaggggauggcgaugaugccagacgacucgcccga

SEQ ID NO: 10198 - RNA, 51 nt, Artificial Sequence
  Description of Artificial Sequence: Synthetic oligonucleotide
gggaggacgaugcggacguugaguguggcgaucgccagacgacucgcccga

SEQ ID NO: 10199 - RNA, 51 nt, Artificial Sequence
  Description of Artificial Sequence: Synthetic oligonucleotide
gggaggacgaugcggaaugauaggauacaccgcuccagacgacucgcccga

SEQ ID NO: 10200 - RNA, 51 nt, Artificial Sequence
  Description of Artificial Sequence: Synthetic oligonucleotide
gggaggacgaugcgguaugaggcgugcuagcuguacagacgacucgcccga

SEQ ID NO: 10201 - RNA, 51 nt, Artificial Sequence
  Description of Artificial Sequence: Synthetic oligonucleotide
gggaggacgaugcgguuugaagcgggauggguccgcagacgacucgcccga

SEQ ID NO: 10202 - RNA, 51 nt, Artificial Sequence
  Description of Artificial Sequence: Synthetic oligonucleotide
gggaggacgaugcggugcccaggauauacuggccucagacgacucgcccga

SEQ ID NO: 10203 - RNA, 49 nt, Artificial Sequence
  Description of Artificial Sequence: Synthetic oligonucleotide
gggaggacgaugcggucaucugcguucgcccugcagacgacucgcccga

SEQ ID NO: 10204 - RNA, 51 nt, Artificial Sequence
  Description of Artificial Sequence: Synthetic oligonucleotide
gggaggacgaugcggcuccguacucccgaacgccacagacgacucgcccga

SEQ ID NO: 10205 - RNA, 50 nt, Artificial Sequence
  Description of Artificial Sequence: Synthetic oligonucleotide
gggaggacgaugcggguaggaggaggagguaccgcagacgacucgcccga

SEQ ID NO: 10206 - RNA, 51 nt, Artificial Sequence
  Description of Artificial Sequence: Synthetic oligonucleotide
gggaggacgaugcgguuugaaggagggugggacugcagacgacucgcccga

SEQ ID NO: 10207 - RNA, 51 nt, Artificial Sequence
  Description of Artificial Sequence: Synthetic oligonucleotide
gggaggacgaugcggauacgugagacauaugccugcagacgacucgcccga

SEQ ID NO: 10208 - RNA, 51 nt, Artificial Sequence
  Description of Artificial Sequence: Synthetic oligonucleotide
gggaggacgaugcggcaccguccuucgacacguaccagacgacucgcccga

SEQ ID NO: 10209 - RNA, 51 nt, Artificial Sequence
  Description of Artificial Sequence: Synthetic oligonucleotide
gggaggacgaugcggugcuaacaucuacacaucugcagacgacucgcccga

SEQ ID NO: 10210 - RNA, 51 nt, Artificial Sequence
  Description of Artificial Sequence: Synthetic oligonucleotide
gggaggacgaugcggcuuccugucgucuuguacugcagacgacucgcccga

SEQ ID NO: 10211 - RNA, 51 nt, Artificial Sequence
  Description of Artificial Sequence: Synthetic oligonucleotide
gggaggacgaugcggugucgauucuggauagggcccagacgacucgcccga

SEQ ID NO: 10212 - RNA, 51 nt, Artificial Sequence
  Description of Artificial Sequence: Synthetic oligonucleotide
gggaggacgaugcgguuggucauuuguacacacuacagacgacucgcccga

SEQ ID NO: 10213 - RNA, 51 nt, Artificial Sequence
  Description of Artificial Sequence: Synthetic oligonucleotide
gggaggacgaugcggcauuuccucugguucguccccagacgacucgcccga

SEQ ID NO: 10214 - RNA, 51 nt, Artificial Sequence
  Description of Artificial Sequence: Synthetic oligonucleotide
gggaggacgaugcgguguccuucgugugcacuccccagacgacucgcccga

SEQ ID NO: 10215 - RNA, 51 nt, Artificial Sequence
  Description of Artificial Sequence: Synthetic oligonucleotide
gggaggacgaugcgguauacggcgggguggggauacagacgacucgcccga

SEQ ID NO: 10216 - RNA, 51 nt, Artificial Sequence
  Description of Artificial Sequence: Synthetic oligonucleotide
gggaggacgaugcggcgaagaagugucgucacggccagacgacucgcccga

SEQ ID NO: 10217 - RNA, 51 nt, Artificial Sequence
  Description of Artificial Sequence: Synthetic oligonucleotide
gggaggacgaugcgguguguuccuagucuguggugcagacgacucgcccga

SEQ ID NO: 10218 - RNA, 51 nt, Artificial Sequence
  Description of Artificial Sequence: Synthetic oligonucleotide
gggaggacgaugcggccauaacaggauauccuccccagacgacucgcccga

SEQ ID NO: 10219 - RNA, 51 nt, Artificial Sequence
  Description of Artificial Sequence: Synthetic oligonucleotide
gggaggacgaugcgguaccguuuaugcuccaugugcagacgacucgcccga

SEQ ID NO: 10220 - RNA, 51 nt, Artificial Sequence
  Description of Artificial Sequence: Synthetic oligonucleotide
gggaggacgaugcgguagggucgaugcuaucugugcagacgacucgcccga

SEQ ID NO: 10221 - RNA, 51 nt, Artificial Sequence
  Description of Artificial Sequence: Synthetic oligonucleotide
gggaggacgaugcggucuguuaacguucacccccccagacgacucgcccga

SEQ ID NO: 10222 - RNA, 51 nt, Artificial Sequence
  Description of Artificial Sequence: Synthetic oligonucleotide
gggaggacgaugcggugagucacuagcuguacgcccagacgacucgcccga

SEQ ID NO: 10223 - RNA, 51 nt, Artificial Sequence
  Description of Artificial Sequence: Synthetic oligonucleotide
gggaggacgaugcgguuugaaggguaaugggaccgcagacgacucgcccga

SEQ ID NO: 10224 - RNA, 51 nt, Artificial Sequence
  Description of Artificial Sequence: Synthetic oligonucleotide
gggaggacgaugcggauagggagaauggugaaccgcagacgacucgcccga

SEQ ID NO: 10225 - RNA, 51 nt, Artificial Sequence
  Description of Artificial Sequence: Synthetic oligonucleotide
gggaggacgaugcgguuuugacgucgguguggccccagacgacucgcccga

SEQ ID NO: 10226 - RNA, 51 nt, Artificial Sequence
  Description of Artificial Sequence: Synthetic oligonucleotide
gggaggacgaugcgguuugaaguaggaugggaccgcagacgacucgcccga

SEQ ID NO: 10227 - RNA, 51 nt, Artificial Sequence
  Description of Artificial Sequence: Synthetic oligonucleotide
gggaggacgaugcggcuacgguuuguuuacgcguacagacgacucgcccga

SEQ ID NO: 10228 - RNA, 51 nt, Artificial Sequence
  Description of Artificial Sequence: Synthetic oligonucleotide
gggaggacgaugcgguugaauguagggugguaccgcagacgacucgcccga

SEQ ID NO: 10229 - RNA, 51 nt, Artificial Sequence
  Description of Artificial Sequence: Synthetic oligonucleotide
gggaggacgaugcggcgaacuguuugguugcuguccagacgacucgcccga

SEQ ID NO: 10230 - RNA, 51 nt, Artificial Sequence
  Description of Artificial Sequence: Synthetic oligonucleotide
gggaggacgaugcggguugcgccugcauuggugugcagacgacucgcccga

SEQ ID NO: 10231 - RNA, 51 nt, Artificial Sequence
  Description of Artificial Sequence: Synthetic oligonucleotide
gggaggacgaugcgguccggucguuacugugaugccagacgacucgcccga

SEQ ID NO: 10232 - RNA, 51 nt, Artificial Sequence
  Description of Artificial Sequence: Synthetic oligonucleotide
gggaggacgaugcggugaggcagaccaauugugugcagacgacucgcccga

SEQ ID NO: 10233 - RNA, 51 nt, Artificial Sequence
  Description of Artificial Sequence: Synthetic oligonucleotide
gggaggacgaugcggcaacuuugaccucugcuccccagacgacucgcccga

SEQ ID NO: 10234 - RNA, 51 nt, Artificial Sequence
  Description of Artificial Sequence: Synthetic oligonucleotide
gggaggacgaugcggacuuacuccuccaccgucugcagacgacucgcccga

SEQ ID NO: 10235 - RNA, 51 nt, Artificial Sequence
  Description of Artificial Sequence: Synthetic oligonucleotide
gggaggacgaugcgggguguccgaacugcugucugcagacgacucgcccga

SEQ ID NO: 10236 - RNA, 51 nt, Artificial Sequence
  Description of Artificial Sequence: Synthetic oligonucleotide
gggaggacgaugcggcgaagaguguuuguguacugcagacgacucgcccga

SEQ ID NO: 10237 - RNA, 51 nt, Artificial Sequence
  Description of Artificial Sequence: Synthetic oligonucleotide
gggaggacgaugcggucgucuuacuagccucccugcagacgacucgcccga

SEQ ID NO: 10238 - RNA, 51 nt, Artificial Sequence
  Description of Artificial Sequence: Synthetic oligonucleotide
gggaggacgaugcggaucgucuuuccccguugccgcagacgacucgcccga

SEQ ID NO: 10239 - RNA, 51 nt, Artificial Sequence
  Description of Artificial Sequence: Synthetic oligonucleotide
gggaggacgaugcgggucuucuggcucaucguccccagacgacucgcccga

SEQ ID NO: 10240 - RNA, 51 nt, Artificial Sequence
  Description of Artificial Sequence: Synthetic oligonucleotide
gggaggacgaugcgggagguuguuugaccgggcgccagacgacucgcccga

SEQ ID NO: 10241 - RNA, 50 nt, Artificial Sequence
  Description of Artificial Sequence: Synthetic oligonucleotide
gggaggacgaugcgguucacguguccugcguccccagacgacucgcccga

SEQ ID NO: 10242 - RNA, 51 nt, Artificial Sequence
  Description of Artificial Sequence: Synthetic oligonucleotide
gggaggacgaugcggaauggacucaccgcagcccgcagacgacucgcccga

SEQ ID NO: 10243 - RNA, 51 nt, Artificial Sequence
  Description of Artificial Sequence: Synthetic oligonucleotide
gggaggacgaugcggcccacauuuugaggacccugcagacgacucgcccga

SEQ ID NO: 10244 - RNA, 51 nt, Artificial Sequence
  Description of Artificial Sequence: Synthetic oligonucleotide
gggaggacgaugcggacguccguguuagcaugcgccagacgacucgcccga

SEQ ID NO: 10245 - RNA, 51 nt, Artificial Sequence
  Description of Artificial Sequence: Synthetic oligonucleotide
gggaggacgaugcgguccuugucgccuugcguccccagacgacucgcccga

SEQ ID NO: 10246 - RNA, 51 nt, Artificial Sequence
  Description of Artificial Sequence: Synthetic oligonucleotide
gggaggacgaugcggaacacuacucaacgcuuugccagacgacucgcccga

SEQ ID NO: 10247 - RNA, 51 nt, Artificial Sequence
  Description of Artificial Sequence: Synthetic oligonucleotide
gggaggacgaugcggcaacauggugagucgcuccccagacgacucgcccga

SEQ ID NO: 10248 - RNA, 51 nt, Artificial Sequence
  Description of Artificial Sequence: Synthetic oligonucleotide
gggaggacgaugcggcacguucaaucgugcguggccagacgacucgcccga

SEQ ID NO: 10249 - RNA, 50 nt, Artificial Sequence
  Description of Artificial Sequence: Synthetic oligonucleotide
gggaggacgaugcggugagcgguucgucuguguccagacgacucgcccga

SEQ ID NO: 10250 - RNA, 51 nt, Artificial Sequence
  Description of Artificial Sequence: Synthetic oligonucleotide
gggaggacgaugcgguggcugacgucgucuaugugcagacgacucgcccga

SEQ ID NO: 10251 - RNA, 51 nt, Artificial Sequence
  Description of Artificial Sequence: Synthetic oligonucleotide
gggaggacgaugcggucguugcccaguucugugcccagacgacucgcccga

SEQ ID NO: 10252 - RNA, 51 nt, Artificial Sequence
  Description of Artificial Sequence: Synthetic oligonucleotide
gggaggacgaugcgggaaaaggcgacaaucugcugcagacgacucgcccga

SEQ ID NO: 10253 - RNA, 51 nt, Artificial Sequence
  Description of Artificial Sequence: Synthetic oligonucleotide
gggaggacgaugcggaaacgguccugcuccuuccccagacgacucgcccga

SEQ ID NO: 10254 - RNA, 51 nt, Artificial Sequence
  Description of Artificial Sequence: Synthetic oligonucleotide
gggaggacgaugcggaaaacacacguuaggcgcugcagacgacucgcccga

SEQ ID NO: 10255 - RNA, 51 nt, Artificial Sequence
  Description of Artificial Sequence: Synthetic oligonucleotide
gggaggacgaugcgguccugcaucaagucuugccgcagacgacucgcccga

SEQ ID NO: 10256 - RNA, 51 nt, Artificial Sequence
  Description of Artificial Sequence: Synthetic oligonucleotide
gggaggacgaugcggugcuugggcaagaccgugugcagacgacucgcccga

SEQ ID NO: 10257 - RNA, 51 nt, Artificial Sequence
  Description of Artificial Sequence: Synthetic oligonucleotide
gggaggacgaugcggacaaucaaauccugccgccccagacgacucgcccga

SEQ ID NO: 10258 - RNA, 51 nt, Artificial Sequence
  Description of Artificial Sequence: Synthetic oligonucleotide
gggaggacgaugcggaucguuuguccguguuugugcagacgacucgcccga

SEQ ID NO: 10259 - RNA, 51 nt, Artificial Sequence
  Description of Artificial Sequence: Synthetic oligonucleotide
gggaggacgaugcggcguuuccccugguucguccccagacgacucgcccga

SEQ ID NO: 10260 - RNA, 51 nt, Artificial Sequence
  Description of Artificial Sequence: Synthetic oligonucleotide
gggaggacgaugcgguaauacaccgugcugcuccccagacgacucgcccga

SEQ ID NO: 10261 - RNA, 51 nt, Artificial Sequence
  Description of Artificial Sequence: Synthetic oligonucleotide
gggaggacgaugcgguuggguguugggugguacugcagacgacucgcccga

SEQ ID NO: 10262 - RNA, 51 nt, Artificial Sequence
  Description of Artificial Sequence: Synthetic oligonucleotide
gggaggacgaugcgguuugaagggugaugauuccgcagacgacucgcccga

SEQ ID NO: 10263 - RNA, 51 nt, Artificial Sequence
  Description of Artificial Sequence: Synthetic oligonucleotide
gggaggacgaugcggauccaugacagcgcugugugcagacgacucgcccga

SEQ ID NO: 10264 - RNA, 51 nt, Artificial Sequence
  Description of Artificial Sequence: Synthetic oligonucleotide
gggaggacgaugcggccuuugaccggucgucuggccagacgacucgcccga

SEQ ID NO: 10265 - RNA, 51 nt, Artificial Sequence
  Description of Artificial Sequence: Synthetic oligonucleotide
gggaggacgaugcggaaugggcucgcuugucacugcagacgacucgcccga

SEQ ID NO: 10266 - RNA, 51 nt, Artificial Sequence
  Description of Artificial Sequence: Synthetic oligonucleotide
gggaggacgaugcggaauauguacgucccccuggccagacgacucgcccga

SEQ ID NO: 10267 - RNA, 51 nt, Artificial Sequence
  Description of Artificial Sequence: Synthetic oligonucleotide
gggaggacgaugcgguaguacgcaguuacccggaccagacgacucgcccga

SEQ ID NO: 10268 - RNA, 51 nt, Artificial Sequence
  Description of Artificial Sequence: Synthetic oligonucleotide
gggaggacgaugcggauaucauguuuucacguguacagacgacucgcccga

SEQ ID NO: 10269 - RNA, 51 nt, Artificial Sequence
  Description of Artificial Sequence: Synthetic oligonucleotide
gggaggacgaugcggugagaguagguuauccggaccagacgacucgcccga

SEQ ID NO: 10270 - RNA, 51 nt, Artificial Sequence
  Description of Artificial Sequence: Synthetic oligonucleotide
gggaggacgaugcgguuugaagagugcuggguccgcagacgacucgcccga

SEQ ID NO: 10271 - RNA, 51 nt, Artificial Sequence
  Description of Artificial Sequence: Synthetic oligonucleotide
gggaggacgaugcggauacuugucuaccccgugcccagacgacucgcccga

SEQ ID NO: 10272 - RNA, 51 nt, Artificial Sequence
  Description of Artificial Sequence: Synthetic oligonucleotide
gggaggacgaugcgguuugaggggugaugggcccgcagacgacucgcccga

SEQ ID NO: 10273 - RNA, 51 nt, Artificial Sequence
  Description of Artificial Sequence: Synthetic oligonucleotide
gggaggacgaugcggaccguugugguaaacugcaccagacgacucgcccga

SEQ ID NO: 10274 - RNA, 51 nt, Artificial Sequence
  Description of Artificial Sequence: Synthetic oligonucleotide
gggaggacgaugcgguccgucauucgucauugccccagacgacucgcccga

SEQ ID NO: 10275 - RNA, 51 nt, Artificial Sequence
  Description of Artificial Sequence: Synthetic oligonucleotide
gggaggacgaugcggguacaaacaccaugaggcugcagacgacucgcccga

SEQ ID NO: 10276 - RNA, 50 nt, Artificial Sequence
  Description of Artificial Sequence: Synthetic oligonucleotide
gggaggacgaugcggugugaucugucgucgcguacagacgacucgcccga

SEQ ID NO: 10277 - RNA, 50 nt, Artificial Sequence
  Description of Artificial Sequence: Synthetic oligonucleotide
gggaggacgaugcggccguccacagucuacugugcagacgacucgcccga

SEQ ID NO: 10278 - RNA, 51 nt, Artificial Sequence
  Description of Artificial Sequence: Synthetic oligonucleotide
gggaggacgaugcggcaucugacuccccagcguaccagacgacucgcccga

SEQ ID NO: 10279 - RNA, 51 nt, Artificial Sequence
  Description of Artificial Sequence: Synthetic oligonucleotide
gggaggacgaugcggcaguaguggucuugcguccccagacgacucgcccga

SEQ ID NO: 10280 - RNA, 51 nt, Artificial Sequence
  Description of Artificial Sequence: Synthetic oligonucleotide
gggaggacgaugcggguugaagggugauguguccgcagacgacucgcccga

SEQ ID NO: 10281 - RNA, 51 nt, Artificial Sequence
  Description of Artificial Sequence: Synthetic oligonucleotide
gggaggacgaugcgguucgagagacuuauccgugucagacgacucgcccga

SEQ ID NO: 10282 - RNA, 51 nt, Artificial Sequence
  Description of Artificial Sequence: Synthetic oligonucleotide
gggaggacgaugcggccgcuuacgaaaaugaucugcagacgacucgcccga

SEQ ID NO: 10283 - RNA, 51 nt, Artificial Sequence
  Description of Artificial Sequence: Synthetic oligonucleotide
gggaggacgaugcggugugccugucuguacacguacagacgacucgcccga

SEQ ID NO: 10284 - RNA, 51 nt, Artificial Sequence
  Description of Artificial Sequence: Synthetic oligonucleotide
gggaggacgaugcggcuaggauauaaacugaucugcagacgacucgcccga

SEQ ID NO: 10285 - RNA, 51 nt, Artificial Sequence
  Description of Artificial Sequence: Synthetic oligonucleotide
gggaggacgaugcggacuccucuucgauguggguacagacgacucgcccga

SEQ ID NO: 10286 - RNA, 51 nt, Artificial Sequence
  Description of Artificial Sequence: Synthetic oligonucleotide
gggaggacgaugcgguuggaagggggguggguccgcagacgacucgcccga

SEQ ID NO: 10287 - RNA, 51 nt, Artificial Sequence
  Description of Artificial Sequence: Synthetic oligonucleotide
gggaggacgaugcggcauucgcaguccguuggccccagacgacucgcccga

SEQ ID NO: 10288 - RNA, 50 nt, Artificial Sequence
  Description of Artificial Sequence: Synthetic oligonucleotide
gggaggacgaugcggugugagcucauuccguugccagacgacucgcccga

SEQ ID NO: 10289 - RNA, 51 nt, Artificial Sequence
  Description of Artificial Sequence: Synthetic oligonucleotide
gggaggacgaugcgguuuuacuccugccucccccccagacgacucgcccga

SEQ ID NO: 10290 - RNA, 51 nt, Artificial Sequence
  Description of Artificial Sequence: Synthetic oligonucleotide
gggaggacgaugcgguccgugaauuuccugcaccccagacgacucgcccga

SEQ ID NO: 10291 - RNA, 51 nt, Artificial Sequence
  Description of Artificial Sequence: Synthetic oligonucleotide
gggaggacgaugcggucguucaagugaccaugccccagacgacucgcccga

SEQ ID NO: 10292 - RNA, 51 nt, Artificial Sequence
  Description of Artificial Sequence: Synthetic oligonucleotide
gggaggacgaugcgguuuggugaggggugggacugcagacgacucgcccga

SEQ ID NO: 10293 - RNA, 51 nt, Artificial Sequence
  Description of Artificial Sequence: Synthetic oligonucleotide
gggaggacgaugcggcagaagucccgauuugccgucagacgacucgcccga

SEQ ID NO: 10294 - RNA, 51 nt, Artificial Sequence
  Description of Artificial Sequence: Synthetic oligonucleotide
gggaggacgaugcggguguuucgucuaccagugcccagacgacucgcccga

SEQ ID NO: 10295 - RNA, 51 nt, Artificial Sequence
  Description of Artificial Sequence: Synthetic oligonucleotide
gggaggacgaugcgguuuggagugggaugggaccgcagacgacucgcccga

SEQ ID NO: 10296 - RNA, 51 nt, Artificial Sequence
  Description of Artificial Sequence: Synthetic oligonucleotide
gggaggacgaugcggaagcaacaacuagccgcguccagacgacucgcccga

SEQ ID NO: 10297 - RNA, 51 nt, Artificial Sequence
  Description of Artificial Sequence: Synthetic oligonucleotide
gggaggacgaugcggugucgaugguugcagcuggccagacgacucgcccga

SEQ ID NO: 10298 - RNA, 51 nt, Artificial Sequence
  Description of Artificial Sequence: Synthetic oligonucleotide
gggaggacgaugcggugggacauagcuuccuugugcagacgacucgcccga

SEQ ID NO: 10299 - RNA, 51 nt, Artificial Sequence
  Description of Artificial Sequence: Synthetic oligonucleotide
gggaggacgaugcgguuugggguagggugguaccgcagacgacucgcccga

SEQ ID NO: 10300 - RNA, 51 nt, Artificial Sequence
  Description of Artificial Sequence: Synthetic oligonucleotide
gggaggacgaugcgguaggcgccgucuuaugugugcagacgacucgcccga

SEQ ID NO: 10301 - RNA, 50 nt, Artificial Sequence
  Description of Artificial Sequence: Synthetic oligonucleotide
gggaggacgaugcggcuauuggugaagggaggugcagacgacucgcccga

SEQ ID NO: 10302 - RNA, 51 nt, Artificial Sequence
  Description of Artificial Sequence: Synthetic oligonucleotide
gggaggacgaugcgggaugacggcgacucgguaaccagacgacucgcccga

SEQ ID NO: 10303 - RNA, 51 nt, Artificial Sequence
  Description of Artificial Sequence: Synthetic oligonucleotide
gggaggacgaugcggucugaauggugauggguccgcagacgacucgcccga

SEQ ID NO: 10304 - RNA, 51 nt, Artificial Sequence
  Description of Artificial Sequence: Synthetic oligonucleotide
gggaggacgaugcggguugaauggugauggguccgcagacgacucgcccga

SEQ ID NO: 10305 - RNA, 51 nt, Artificial Sequence
  Description of Artificial Sequence: Synthetic oligonucleotide
gggaggacgaugcgguuugaaggaugcuggguccgcagacgacucgcccga

SEQ ID NO: 10306 - RNA, 51 nt, Artificial Sequence
  Description of Artificial Sequence: Synthetic oligonucleotide
gggaggacgaugcggaaggugugucgugcuguguccagacgacucgcccga

SEQ ID NO: 10307 - RNA, 51 nt, Artificial Sequence
  Description of Artificial Sequence: Synthetic oligonucleotide
gggaggacgaugcggacauacacuugugucccguacagacgacucgcccga

SEQ ID NO: 10308 - RNA, 51 nt, Artificial Sequence
  Description of Artificial Sequence: Synthetic oligonucleotide
gggaggacgaugcgguuuggagggggaagggacugcagacgacucgcccga

SEQ ID NO: 10309 - RNA, 51 nt, Artificial Sequence
  Description of Artificial Sequence: Synthetic oligonucleotide
gggaggacgaugcggcgaaucguacucguguucugcagacgacucgcccga

SEQ ID NO: 10310 - RNA, 51 nt, Artificial Sequence
  Description of Artificial Sequence: Synthetic oligonucleotide
gggaggacgaugcgguuugaagggggaugcguccgcagacgacucgcccga

SEQ ID NO: 10311 - RNA, 51 nt, Artificial Sequence
  Description of Artificial Sequence: Synthetic oligonucleotide
gggaggacgaugcgguuuugagggugauggguccgcagacgacucgcccga

SEQ ID NO: 10312 - RNA, 51 nt, Artificial Sequence
  Description of Artificial Sequence: Synthetic oligonucleotide
gggaggacgaugcgguguaggacgaggagguaccgcagacgacucgcccga

SEQ ID NO: 10313 - RNA, 51 nt, Artificial Sequence
  Description of Artificial Sequence: Synthetic oligonucleotide
gggaggacgaugcggucgguugcugcuucuguccccagacgacucgcccga

SEQ ID NO: 10314 - RNA, 51 nt, Artificial Sequence
  Description of Artificial Sequence: Synthetic oligonucleotide
gggaggacgaugcggauacacucaaaccagugcuccagacgacucgcccga

SEQ ID NO: 10315 - RNA, 51 nt, Artificial Sequence
  Description of Artificial Sequence: Synthetic oligonucleotide
gggaggacgaugcgguccaucagagucuguucccccagacgacucgcccga

SEQ ID NO: 10316 - RNA, 51 nt, Artificial Sequence
  Description of Artificial Sequence: Synthetic oligonucleotide
gggaggacgaugcgguuugaaaggggauggguccgcagacgacucgcccga

SEQ ID NO: 10317 - RNA, 51 nt, Artificial Sequence
  Description of Artificial Sequence: Synthetic oligonucleotide
gggaggacgaugcgguccucguugcauacgcacugcagacgacucgcccga

SEQ ID NO: 10318 - RNA, 51 nt, Artificial Sequence
  Description of Artificial Sequence: Synthetic oligonucleotide
gggaggacgaugcgguuugaaguguguuggguccgcagacgacucgcccga

SEQ ID NO: 10319 - RNA, 51 nt, Artificial Sequence
  Description of Artificial Sequence: Synthetic oligonucleotide
gggaggacgaugcgguaaacugugacaguugguggcagacgacucgcccga

SEQ ID NO: 10320 - RNA, 51 nt, Artificial Sequence
  Description of Artificial Sequence: Synthetic oligonucleotide
gggaggacgaugcgguuugaagggugauggaaccgcagacgacucgcccga

SEQ ID NO: 10321 - RNA, 51 nt, Artificial Sequence
  Description of Artificial Sequence: Synthetic oligonucleotide
gggaggacgaugcggcuggguguagggggguaccgcagacgacucgcccga

SEQ ID NO: 10322 - RNA, 51 nt, Artificial Sequence
  Description of Artificial Sequence: Synthetic oligonucleotide
gggaggacgaugcgguugggugcagugugguaccgcagacgacucgcccga

SEQ ID NO: 10323 - RNA, 51 nt, Artificial Sequence
  Description of Artificial Sequence: Synthetic oligonucleotide
gggaggacgaugcgguugggaguagggugguuccgcagacgacucgcccga

SEQ ID NO: 10324 - RNA, 51 nt, Artificial Sequence
  Description of Artificial Sequence: Synthetic oligonucleotide
gggaggacgaugcggaaucgaacgggcacauugcccagacgacucgcccga

SEQ ID NO: 10325 - RNA, 51 nt, Artificial Sequence
  Description of Artificial Sequence: Synthetic oligonucleotide
gggaggacgaugcggacaucaagauuguguaccgccagacgacucgcccga

SEQ ID NO: 10326 - RNA, 51 nt, Artificial Sequence
  Description of Artificial Sequence: Synthetic oligonucleotide
gggaggacgaugcggugggugagcaugucaugggccagacgacucgcccga

SEQ ID NO: 10327 - RNA, 51 nt, Artificial Sequence
  Description of Artificial Sequence: Synthetic oligonucleotide
gggaggacgaugcggcgauuccucugcuucguccccagacgacucgcccga

SEQ ID NO: 10328 - RNA, 51 nt, Artificial Sequence
  Description of Artificial Sequence: Synthetic oligonucleotide
gggaggacgaugcgguauuggagguguagcgaccgcagacgacucgcccga

SEQ ID NO: 10329 - RNA, 51 nt, Artificial Sequence
  Description of Artificial Sequence: Synthetic oligonucleotide
gggaggacgaugcggucaauguccacccgcgucaccagacgacucgcccga

SEQ ID NO: 10330 - RNA, 51 nt, Artificial Sequence
  Description of Artificial Sequence: Synthetic oligonucleotide
gggaggacgaugcgguggucuucgauuccuccccccagacgacucgcccga

SEQ ID NO: 10331 - RNA, 51 nt, Artificial Sequence
  Description of Artificial Sequence: Synthetic oligonucleotide
gggaggacgaugcgguuugaagggggauggguacgcagacgacucgcccga

SEQ ID NO: 10332 - RNA, 51 nt, Artificial Sequence
  Description of Artificial Sequence: Synthetic oligonucleotide
gggaggacgaugcgguuuuaagggggauggguccgcagacgacucgcccga

SEQ ID NO: 10333 - RNA, 51 nt, Artificial Sequence
  Description of Artificial Sequence: Synthetic oligonucleotide
gggaggacgaugcggguauguccacuggguuggcccagacgacucgcccga

SEQ ID NO: 10334 - RNA, 51 nt, Artificial Sequence
  Description of Artificial Sequence: Synthetic oligonucleotide
gggaggacgaugcgguauuggagguuuagggaccgcagacgacucgcccga

SEQ ID NO: 10335 - RNA, 50 nt, Artificial Sequence
  Description of Artificial Sequence: Synthetic oligonucleotide
gggaggacgaugcgguuuccuucccugaacuggccagacgacucgcccga

SEQ ID NO: 10336 - RNA, 51 nt, Artificial Sequence
  Description of Artificial Sequence: Synthetic oligonucleotide
gggaggacgaugcggcuugucaucuuguucguccccagacgacucgcccga

SEQ ID NO: 10337 - RNA, 51 nt, Artificial Sequence
  Description of Artificial Sequence: Synthetic oligonucleotide
gggaggacgaugcggaugaucgugcacccuguggucagacgacucgcccga

SEQ ID NO: 10338 - RNA, 51 nt, Artificial Sequence
  Description of Artificial Sequence: Synthetic oligonucleotide
gggaggacgaugcggagccgcacaaguauuguggccagacgacucgcccga

SEQ ID NO: 10339 - RNA, 51 nt, Artificial Sequence
  Description of Artificial Sequence: Synthetic oligonucleotide
gggaggacgaugcggaauggcccauaacguaucugcagacgacucgcccga

SEQ ID NO: 10340 - RNA, 51 nt, Artificial Sequence
  Description of Artificial Sequence: Synthetic oligonucleotide
gggaggacgaugcggcaucaaccuccguccuaccccagacgacucgcccga

SEQ ID NO: 10341 - RNA, 51 nt, Artificial Sequence
  Description of Artificial Sequence: Synthetic oligonucleotide
gggaggacgaugcggauuggugaauggagggacugcagacgacucgcccga

SEQ ID NO: 10342 - RNA, 51 nt, Artificial Sequence
  Description of Artificial Sequence: Synthetic oligonucleotide
gggaggacgaugcggucauucaucauguuuagcugcagacgacucgcccga

SEQ ID NO: 10343 - RNA, 51 nt, Artificial Sequence
  Description of Artificial Sequence: Synthetic oligonucleotide
gggaggacgaugcggaucggugaagggaggcacugcagacgacucgcccga

SEQ ID NO: 10344 - RNA, 51 nt, Artificial Sequence
  Description of Artificial Sequence: Synthetic oligonucleotide
gggaggacgaugcgguuugaagggugaaugguccgcagacgacucgcccga

SEQ ID NO: 10345 - RNA, 51 nt, Artificial Sequence
  Description of Artificial Sequence: Synthetic oligonucleotide
gggaggacgaugcggaaguuccucgugucguugaccagacgacucgcccga

SEQ ID NO: 10346 - RNA, 51 nt, Artificial Sequence
  Description of Artificial Sequence: Synthetic oligonucleotide
gggaggacgaugcggacaauacacuguacccgccccagacgacucgcccga

SEQ ID NO: 10347 - RNA, 51 nt, Artificial Sequence
  Description of Artificial Sequence: Synthetic oligonucleotide
gggaggacgaugcgggauccaucaaugguuugcgccagacgacucgcccga

SEQ ID NO: 10348 - RNA, 51 nt, Artificial Sequence
  Description of Artificial Sequence: Synthetic oligonucleotide
gggaggacgaugcggucuuuccucuugucgugcaccagacgacucgcccga

SEQ ID NO: 10349 - RNA, 51 nt, Artificial Sequence
  Description of Artificial Sequence: Synthetic oligonucleotide
gggaggacgaugcggauugguggagggggguacugcagacgacucgcccga

SEQ ID NO: 10350 - RNA, 51 nt, Artificial Sequence
  Description of Artificial Sequence: Synthetic oligonucleotide
gggaggacgaugcgguuugaaggguuauugguccgcagacgacucgcccga

SEQ ID NO: 10351 - RNA, 51 nt, Artificial Sequence
  Description of Artificial Sequence: Synthetic oligonucleotide
gggaggacgaugcggaaagaaagucacacaaucugcagacgacucgcccga

SEQ ID NO: 10352 - RNA, 51 nt, Artificial Sequence
  Description of Artificial Sequence: Synthetic oligonucleotide
gggaggacgaugcggacacaacucuuggaguggcccagacgacucgcccga

SEQ ID NO: 10353 - RNA, 50 nt, Artificial Sequence
  Description of Artificial Sequence: Synthetic oligonucleotide
gggaggacgaugcggguccuucugucguaugguacagacgacucgcccga

SEQ ID NO: 10354 - RNA, 51 nt, Artificial Sequence
  Description of Artificial Sequence: Synthetic oligonucleotide
gggaggacgaugcgguuuguagggugauggguccccagacgacucgcccga

SEQ ID NO: 10355 - RNA, 51 nt, Artificial Sequence
  Description of Artificial Sequence: Synthetic oligonucleotide
gggaggacgaugcgguuugaagugugaugggaccgcagacgacucgcccga

SEQ ID NO: 10356 - RNA, 51 nt, Artificial Sequence
  Description of Artificial Sequence: Synthetic oligonucleotide
gggaggacgaugcgguucauggacuauagcacccccagacgacucgcccga

SEQ ID NO: 10357 - RNA, 51 nt, Artificial Sequence
  Description of Artificial Sequence: Synthetic oligonucleotide
gggaggacgaugcggccgcaugaucuaccucugcacagacgacucgcccga

SEQ ID NO: 10358 - RNA, 51 nt, Artificial Sequence
  Description of Artificial Sequence: Synthetic oligonucleotide
gggaggacgaugcggucgguucguucugucauccccagacgacucgcccga

SEQ ID NO: 10359 - RNA, 51 nt, Artificial Sequence
  Description of Artificial Sequence: Synthetic oligonucleotide
gggaggacgaugcggucuuugccucccuugguugccagacgacucgcccga

SEQ ID NO: 10360 - RNA, 51 nt, Artificial Sequence
  Description of Artificial Sequence: Synthetic oligonucleotide
gggaggacgaugcggggcgaaguuuauaacggcugcagacgacucgcccga

SEQ ID NO: 10361 - RNA, 51 nt, Artificial Sequence
  Description of Artificial Sequence: Synthetic oligonucleotide
gggaggacgaugcgguuugaagggugaugggacggcagacgacucgcccga

SEQ ID NO: 10362 - RNA, 51 nt, Artificial Sequence
  Description of Artificial Sequence: Synthetic oligonucleotide
gggaggacgaugcgggugucugauuugccuccccccagacgacucgcccga

SEQ ID NO: 10363 - RNA, 51 nt, Artificial Sequence
  Description of Artificial Sequence: Synthetic oligonucleotide
gggaggacgaugcgguugggagucgggugguaccgcagacgacucgcccga

SEQ ID NO: 10364 - RNA, 52 nt, Artificial Sequence
  Description of Artificial Sequence: Synthetic oligonucleotide
gggaggacgaugcgguuuugaagggugauggguccacagacgacucgcccga

SEQ ID NO: 10365 - RNA, 51 nt, Artificial Sequence
  Description of Artificial Sequence: Synthetic oligonucleotide
gggaggacgaugcgguacuccugaucgucagugcccagacgacucgcccga

SEQ ID NO: 10366 - RNA, 51 nt, Artificial Sequence
  Description of Artificial Sequence: Synthetic oligonucleotide
gggaggacgaugcggucacggauggaggugaugugcagacgacucgcccga

SEQ ID NO: 10367 - RNA, 49 nt, Artificial Sequence
  Description of Artificial Sequence: Synthetic oligonucleotide
gggaggacgaugcgggccuuucguucugccucccagacgacucgcccga

SEQ ID NO: 10368 - RNA, 51 nt, Artificial Sequence
  Description of Artificial Sequence: Synthetic oligonucleotide
gggaggacgaugcggucggguguaggguguuaccgcagacgacucgcccga

SEQ ID NO: 10369 - RNA, 51 nt, Artificial Sequence
  Description of Artificial Sequence: Synthetic oligonucleotide
gggaggacgaugcgguuugaagggugauagggccgcagacgacucgcccga

SEQ ID NO: 10370 - RNA, 51 nt, Artificial Sequence
  Description of Artificial Sequence: Synthetic oligonucleotide
gggaggacgaugcgggaaaagugaauaggcuaccccagacgacucgcccga

SEQ ID NO: 10371 - RNA, 50 nt, Artificial Sequence
  Description of Artificial Sequence: Synthetic oligonucleotide
gggaggacgaugcgguugguuuagggugguaccgcagacgacucgcccga

SEQ ID NO: 10372 - RNA, 51 nt, Artificial Sequence
  Description of Artificial Sequence: Synthetic oligonucleotide
gggaggacgaugcggaccguuucgucgccaagcaccagacgacucgcccga

SEQ ID NO: 10373 - RNA, 51 nt, Artificial Sequence
  Description of Artificial Sequence: Synthetic oligonucleotide
gggaggacgaugcggaauucauuuccucccccccccagacgacucgcccga

SEQ ID NO: 10374 - RNA, 51 nt, Artificial Sequence
  Description of Artificial Sequence: Synthetic oligonucleotide
gggaggacgaugcgguuggguauagggugguacugcagacgacucgcccga

SEQ ID NO: 10375 - RNA, 51 nt, Artificial Sequence
  Description of Artificial Sequence: Synthetic oligonucleotide
gggaggacgaugcgguccaggcagaaucgucaccacagacgacucgcccga

SEQ ID NO: 10376 - RNA, 51 nt, Artificial Sequence
  Description of Artificial Sequence: Synthetic oligonucleotide
gggaggacgaugcggucuuccgaagcgugguucugcagacgacucgcccga

SEQ ID NO: 10377 - RNA, 51 nt, Artificial Sequence
  Description of Artificial Sequence: Synthetic oligonucleotide
gggaggacgaugcgguuucccuuucgacugcugcccagacgacucgcccga

SEQ ID NO: 10378 - RNA, 51 nt, Artificial Sequence
  Description of Artificial Sequence: Synthetic oligonucleotide
gggaggacgaugcggucccucuuuuguucgugguccagacgacucgcccga

SEQ ID NO: 10379 - RNA, 51 nt, Artificial Sequence
  Description of Artificial Sequence: Synthetic oligonucleotide
gggaggacgaugcgguuggaaggggggugguaccgcagacgacucgcccga

SEQ ID NO: 10380 - RNA, 51 nt, Artificial Sequence
  Description of Artificial Sequence: Synthetic oligonucleotide
gggaggacgaugcgguucacuccaaaacacaccgccagacgacucgcccga

SEQ ID NO: 10381 - RNA, 51 nt, Artificial Sequence
  Description of Artificial Sequence: Synthetic oligonucleotide
gggaggacgaugcggucagugugauaauauugcggcagacgacucgcccga

SEQ ID NO: 10382 - RNA, 51 nt, Artificial Sequence
  Description of Artificial Sequence: Synthetic oligonucleotide
gggaggacgaugcgguuugguguauggugguaccgcagacgacucgcccga

SEQ ID NO: 10383 - RNA, 51 nt, Artificial Sequence
  Description of Artificial Sequence: Synthetic oligonucleotide
gggaggacgaugcggguuggugaagggagggacugcagacgacucgcccga

SEQ ID NO: 10384 - RNA, 51 nt, Artificial Sequence
  Description of Artificial Sequence: Synthetic oligonucleotide
gggaggacgaugcggccugauguuacuauucgugccagacgacucgcccga

SEQ ID NO: 10385 - RNA, 51 nt, Artificial Sequence
  Description of Artificial Sequence: Synthetic oligonucleotide
gggaggacgaugcggugacgagcgugcguuugguccagacgacucgcccga

SEQ ID NO: 10386 - RNA, 51 nt, Artificial Sequence
  Description of Artificial Sequence: Synthetic oligonucleotide
gggaggacgaugcgguuggguguggggugggaccgcagacgacucgcccga

SEQ ID NO: 10387 - RNA, 51 nt, Artificial Sequence
  Description of Artificial Sequence: Synthetic oligonucleotide
gggaggacgaugcgguucaccuuuucgauccgccccagacgacucgcccga

SEQ ID NO: 10388 - RNA, 51 nt, Artificial Sequence
  Description of Artificial Sequence: Synthetic oligonucleotide
gggaggacgaugcgguuugacgggugaugggaccgcagacgacucgcccga

SEQ ID NO: 10389 - RNA, 51 nt, Artificial Sequence
  Description of Artificial Sequence: Synthetic oligonucleotide
gggaggacgaugcggacuagcaucacgguuguccacagacgacucgcccga

SEQ ID NO: 10390 - RNA, 49 nt, Artificial Sequence
  Description of Artificial Sequence: Synthetic oligonucleotide
gggaggacgaugcgguuggguguggugguaccgcagacgacucgcccga

SEQ ID NO: 10391 - RNA, 51 nt, Artificial Sequence
  Description of Artificial Sequence: Synthetic oligonucleotide
gggaggacgaugcggcagagguuggucgucgaggccagacgacucgcccga

SEQ ID NO: 10392 - RNA, 51 nt, Artificial Sequence
  Description of Artificial Sequence: Synthetic oligonucleotide
gggaggacgaugcggguuuuacaagguacagucugcagacgacucgcccga

SEQ ID NO: 10393 - RNA, 51 nt, Artificial Sequence
  Description of Artificial Sequence: Synthetic oligonucleotide
gggaggacgaugcgguuugaagggugaugccuccgcagacgacucgcccga

SEQ ID NO: 10394 - RNA, 51 nt, Artificial Sequence
  Description of Artificial Sequence: Synthetic oligonucleotide
gggaggacgaugcgguuugaaggaggaugggacugcagacgacucgcccga

SEQ ID NO: 10395 - RNA, 51 nt, Artificial Sequence
  Description of Artificial Sequence: Synthetic oligonucleotide
gggaggacgaugcggaauccucuguguugucuggccagacgacucgcccga

SEQ ID NO: 10396 - RNA, 51 nt, Artificial Sequence
  Description of Artificial Sequence: Synthetic oligonucleotide
gggaggacgaugcgggcagggaaacucuugacgcccagacgacucgcccga

SEQ ID NO: 10397 - RNA, 51 nt, Artificial Sequence
  Description of Artificial Sequence: Synthetic oligonucleotide
gggaggacgaugcgguuugcagggugaugcguccgcagacgacucgcccga

SEQ ID NO: 10398 - RNA, 51 nt, Artificial Sequence
  Description of Artificial Sequence: Synthetic oligonucleotide
gggaggacgaugcggucgggucgugcguguguugccagacgacucgcccga

SEQ ID NO: 10399 - RNA, 51 nt, Artificial Sequence
  Description of Artificial Sequence: Synthetic oligonucleotide
gggaggacgaugcgguccucaugucuaugucuccgcagacgacucgcccga

SEQ ID NO: 10400 - RNA, 51 nt, Artificial Sequence
  Description of Artificial Sequence: Synthetic oligonucleotide
gggaggacgaugcgguccaacgucgauucuguugccagacgacucgcccga

SEQ ID NO: 10401 - RNA, 51 nt, Artificial Sequence
  Description of Artificial Sequence: Synthetic oligonucleotide
gggaggacgaugcggucauucccuuagcgacuccgcagacgacucgcccga

SEQ ID NO: 10402 - RNA, 51 nt, Artificial Sequence
  Description of Artificial Sequence: Synthetic oligonucleotide
gggaggacgaugcggacagcccuauauuguuaccgcagacgacucgcccga

SEQ ID NO: 10403 - RNA, 51 nt, Artificial Sequence
  Description of Artificial Sequence: Synthetic oligonucleotide
gggaggacgaugcgguuugaagguuguuggguccgcagacgacucgcccga

SEQ ID NO: 10404 - RNA, 51 nt, Artificial Sequence
  Description of Artificial Sequence: Synthetic oligonucleotide
gggaggacgaugcgggcuuaucuucguuugugcgccagacgacucgcccga

SEQ ID NO: 10405 - RNA, 51 nt, Artificial Sequence
  Description of Artificial Sequence: Synthetic oligonucleotide
gggaggacgaugcggucauccuauguaguguugugcagacgacucgcccga

SEQ ID NO: 10406 - RNA, 51 nt, Artificial Sequence
  Description of Artificial Sequence: Synthetic oligonucleotide
gggaggacgaugcgguccuuaagcguacuggugcccagacgacucgcccga

SEQ ID NO: 10407 - RNA, 51 nt, Artificial Sequence
  Description of Artificial Sequence: Synthetic oligonucleotide
gggaggacgaugcggggaugguuguggcuauacgccagacgacucgcccga

SEQ ID NO: 10408 - RNA, 51 nt, Artificial Sequence
  Description of Artificial Sequence: Synthetic oligonucleotide
gggaggacgaugcggguccgucugacuuaucccugcagacgacucgcccga

SEQ ID NO: 10409 - RNA, 51 nt, Artificial Sequence
  Description of Artificial Sequence: Synthetic oligonucleotide
gggaggacgaugcgguccugcguaaacucgugccgcagacgacucgcccga

SEQ ID NO: 10410 - RNA, 51 nt, Artificial Sequence
  Description of Artificial Sequence: Synthetic oligonucleotide
gggaggacgaugcgguauugccacggggcaauagccagacgacucgcccga

SEQ ID NO: 10411 - RNA, 51 nt, Artificial Sequence
  Description of Artificial Sequence: Synthetic oligonucleotide
gggaggacgaugcgguaucgaaacagucuggucugcagacgacucgcccga

SEQ ID NO: 10412 - RNA, 51 nt, Artificial Sequence
  Description of Artificial Sequence: Synthetic oligonucleotide
gggaggacgaugcggugggcaugagaucguaggaccagacgacucgcccga

SEQ ID NO: 10413 - RNA, 51 nt, Artificial Sequence
  Description of Artificial Sequence: Synthetic oligonucleotide
gggaggacgaugcgggcgaaaugucgugcucuccccagacgacucgcccga

SEQ ID NO: 10414 - RNA, 51 nt, Artificial Sequence
  Description of Artificial Sequence: Synthetic oligonucleotide
gggaggacgaugcgguugggaguaggguggguccgcagacgacucgcccga

SEQ ID NO: 10415 - RNA, 51 nt, Artificial Sequence
  Description of Artificial Sequence: Synthetic oligonucleotide
gggaggacgaugcgggaccgcgauccaucuccguacagacgacucgcccga

SEQ ID NO: 10416 - RNA, 51 nt, Artificial Sequence
  Description of Artificial Sequence: Synthetic oligonucleotide
gggaggacgaugcggucaguuagucccguccgugccagacgacucgcccga

SEQ ID NO: 10417 - RNA, 51 nt, Artificial Sequence
  Description of Artificial Sequence: Synthetic oligonucleotide
gggaggacgaugcggaguggacuaugaugauggcccagacgacucgcccga

SEQ ID NO: 10418 - RNA, 51 nt, Artificial Sequence
  Description of Artificial Sequence: Synthetic oligonucleotide
gggaggacgaugcggucuucgaaaaccgaguugugcagacgacucgcccga

SEQ ID NO: 10419 - RNA, 51 nt, Artificial Sequence
  Description of Artificial Sequence: Synthetic oligonucleotide
gggaggacgaugcggaguggccuauaccacuuggccagacgacucgcccga

SEQ ID NO: 10420 - RNA, 51 nt, Artificial Sequence
  Description of Artificial Sequence: Synthetic oligonucleotide
gggaggacgaugcgggaaagcacacuggacuugugcagacgacucgcccga

SEQ ID NO: 10421 - RNA, 51 nt, Artificial Sequence
  Description of Artificial Sequence: Synthetic oligonucleotide
gggaggacgaugcgguguuguuagucugauguugccagacgacucgcccga

SEQ ID NO: 10422 - RNA, 51 nt, Artificial Sequence
  Description of Artificial Sequence: Synthetic oligonucleotide
gggaggacgaugcgguuagagcuugcauugggcaccagacgacucgcccga

SEQ ID NO: 10423 - RNA, 51 nt, Artificial Sequence
  Description of Artificial Sequence: Synthetic oligonucleotide
gggaggacgaugcggcguugucuucuucacguguccagacgacucgcccga

SEQ ID NO: 10424 - RNA, 51 nt, Artificial Sequence
  Description of Artificial Sequence: Synthetic oligonucleotide
gggaggacgaugcggugaaacaaaucuaugcuccccagacgacucgcccga

SEQ ID NO: 10425 - RNA, 51 nt, Artificial Sequence
  Description of Artificial Sequence: Synthetic oligonucleotide
gggaggacgaugcggguacgugugagcaauguggccagacgacucgcccga

SEQ ID NO: 10426 - RNA, 51 nt, Artificial Sequence
  Description of Artificial Sequence: Synthetic oligonucleotide
gggaggacgaugcggacgaugaucgucuguacggccagacgacucgcccga

SEQ ID NO: 10427 - RNA, 51 nt, Artificial Sequence
  Description of Artificial Sequence: Synthetic oligonucleotide
gggaggacgaugcggucgcagaaaggaugcgugcccagacgacucgcccga

SEQ ID NO: 10428 - RNA, 51 nt, Artificial Sequence
  Description of Artificial Sequence: Synthetic oligonucleotide
gggaggacgaugcgguacugaaaacaaacugucugcagacgacucgcccga

SEQ ID NO: 10429 - RNA, 51 nt, Artificial Sequence
  Description of Artificial Sequence: Synthetic oligonucleotide
gggaggacgaugcgguugggcguauggugguaccgcagacgacucgcccga

SEQ ID NO: 10430 - RNA, 51 nt, Artificial Sequence
  Description of Artificial Sequence: Synthetic oligonucleotide
gggaggacgaugcgguuugaagagugaugggaccgcagacgacucgcccga

SEQ ID NO: 10431 - RNA, 51 nt, Artificial Sequence
  Description of Artificial Sequence: Synthetic oligonucleotide
gggaggacgaugcgggccguuaucuggugugcgugcagacgacucgcccga

SEQ ID NO: 10432 - RNA, 51 nt, Artificial Sequence
  Description of Artificial Sequence: Synthetic oligonucleotide
gggaggacgaugcgguuugaagggugaugggucuacagacgacucgcccga

SEQ ID NO: 10433 - RNA, 51 nt, Artificial Sequence
  Description of Artificial Sequence: Synthetic oligonucleotide
gggaggacgaugcgggcuucaaagucuuccgugugcagacgacucgcccga

SEQ ID NO: 10434 - RNA, 51 nt, Artificial Sequence
  Description of Artificial Sequence: Synthetic oligonucleotide
gggaggacgaugcgguccugucguuuuugcguccccagacgacucgcccga

SEQ ID NO: 10435 - RNA, 51 nt, Artificial Sequence
  Description of Artificial Sequence: Synthetic oligonucleotide
gggaggacgaugcggaacuagccgagcgguaucgccagacgacucgcccga

SEQ ID NO: 10436 - RNA, 51 nt, Artificial Sequence
  Description of Artificial Sequence: Synthetic oligonucleotide
gggaggacgaugcgguuacaacacguccccauccccagacgacucgcccga

SEQ ID NO: 10437 - RNA, 51 nt, Artificial Sequence
  Description of Artificial Sequence: Synthetic oligonucleotide
gggaggacgaugcgguaagcaacuccaugauacugcagacgacucgcccga

SEQ ID NO: 10438 - RNA, 51 nt, Artificial Sequence
  Description of Artificial Sequence: Synthetic oligonucleotide
gggaggacgaugcgguuugagcggugauggguccgcagacgacucgcccga

SEQ ID NO: 10439 - RNA, 51 nt, Artificial Sequence
  Description of Artificial Sequence: Synthetic oligonucleotide
gggaggacgaugcgggccgcgucuagccuucguaccagacgacucgcccga

SEQ ID NO: 10440 - RNA, 51 nt, Artificial Sequence
  Description of Artificial Sequence: Synthetic oligonucleotide
gggaggacgaugcggguuaguccaaaucgcguguacagacgacucgcccga

SEQ ID NO: 10441 - RNA, 51 nt, Artificial Sequence
  Description of Artificial Sequence: Synthetic oligonucleotide
gggaggacgaugcgggacaguguuaaaaggggccgcagacgacucgcccga

SEQ ID NO: 10442 - RNA, 51 nt, Artificial Sequence
  Description of Artificial Sequence: Synthetic oligonucleotide
gggaggacgaugcgggccuuucguucugcucuacccagacgacucgcccga

SEQ ID NO: 10443 - RNA, 51 nt, Artificial Sequence
  Description of Artificial Sequence: Synthetic oligonucleotide
gggaggacgaugcggucguacgagugcaucuggugcagacgacucgcccga

SEQ ID NO: 10444 - RNA, 51 nt, Artificial Sequence
  Description of Artificial Sequence: Synthetic oligonucleotide
gggaggacgaugcgggcuuacgucucaauccaccccagacgacucgcccga

SEQ ID NO: 10445 - RNA, 51 nt, Artificial Sequence
  Description of Artificial Sequence: Synthetic oligonucleotide
gggaggacgaugcggguggguguagggcgguaccgcagacgacucgcccga

SEQ ID NO: 10446 - RNA, 51 nt, Artificial Sequence
  Description of Artificial Sequence: Synthetic oligonucleotide
gggaggacgaugcgguaagcaaaacuauacagccgcagacgacucgcccga

SEQ ID NO: 10447 - RNA, 51 nt, Artificial Sequence
  Description of Artificial Sequence: Synthetic oligonucleotide
gggaggacgaugcggaacacuauaccacgggacugcagacgacucgcccga

SEQ ID NO: 10448 - RNA, 51 nt, Artificial Sequence
  Description of Artificial Sequence: Synthetic oligonucleotide
gggaggacgaugcggacgagacugcggccugugaccagacgacucgcccga

SEQ ID NO: 10449 - RNA, 51 nt, Artificial Sequence
  Description of Artificial Sequence: Synthetic oligonucleotide
gggaggacgaugcggguugucauguuugagcugugcagacgacucgcccga

SEQ ID NO: 10450 - RNA, 51 nt, Artificial Sequence
  Description of Artificial Sequence: Synthetic oligonucleotide
gggaggacgaugcgggcauaacguacuggucaccccagacgacucgcccga

SEQ ID NO: 10451 - RNA, 51 nt, Artificial Sequence
  Description of Artificial Sequence: Synthetic oligonucleotide
gggaggacgaugcgguuccuuuccucccguuuugccagacgacucgcccga

SEQ ID NO: 10452 - RNA, 51 nt, Artificial Sequence
  Description of Artificial Sequence: Synthetic oligonucleotide
gggaggacgaugcgguugauuuagguugggugcugcagacgacucgcccga

SEQ ID NO: 10453 - RNA, 51 nt, Artificial Sequence
  Description of Artificial Sequence: Synthetic oligonucleotide
gggaggacgaugcggacgugguguagggagguguccagacgacucgcccga

SEQ ID NO: 10454 - RNA, 51 nt, Artificial Sequence
  Description of Artificial Sequence: Synthetic oligonucleotide
gggaggacgaugcggcuugucgucuuguucgugcccagacgacucgcccga

SEQ ID NO: 10455 - RNA, 50 nt, Artificial Sequence
  Description of Artificial Sequence: Synthetic oligonucleotide
gggaggacgaugcggacuaguaaaccuccguggccagacgacucgcccga

SEQ ID NO: 10456 - RNA, 51 nt, Artificial Sequence
  Description of Artificial Sequence: Synthetic oligonucleotide
gggaggacgaugcggaguuugauguugauggugugcagacgacucgcccga

SEQ ID NO: 10457 - RNA, 51 nt, Artificial Sequence
  Description of Artificial Sequence: Synthetic oligonucleotide
gggaggacgaugcgguuugaagggugaugcggccgcagacgacucgcccga

SEQ ID NO: 10458 - RNA, 51 nt, Artificial Sequence
  Description of Artificial Sequence: Synthetic oligonucleotide
gggaggacgaugcgguuggguggaggguggcaccgcagacgacucgcccga

SEQ ID NO: 10459 - RNA, 51 nt, Artificial Sequence
  Description of Artificial Sequence: Synthetic oligonucleotide
gggaggacgaugcggucuuugucgucuugcguccccagacgacucgcccga

SEQ ID NO: 10460 - RNA, 51 nt, Artificial Sequence
  Description of Artificial Sequence: Synthetic oligonucleotide
gggaggacgaugcgguauucgauuucgucgugguccagacgacucgcccga

SEQ ID NO: 10461 - RNA, 51 nt, Artificial Sequence
  Description of Artificial Sequence: Synthetic oligonucleotide
gggaggacgaugcgguaauuucguccuaacguccccagacgacucgcccga

SEQ ID NO: 10462 - RNA, 51 nt, Artificial Sequence
  Description of Artificial Sequence: Synthetic oligonucleotide
gggaggacgaugcgguuggguguggggugguuccgcagacgacucgcccga

SEQ ID NO: 10463 - RNA, 51 nt, Artificial Sequence
  Description of Artificial Sequence: Synthetic oligonucleotide
gggaggacgaugcgguuugagggguguuggguccgcagacgacucgcccga

SEQ ID NO: 10464 - RNA, 51 nt, Artificial Sequence
  Description of Artificial Sequence: Synthetic oligonucleotide
gggaggacgaugcgguaaccgaaaucuguagugugcagacgacucgcccga

SEQ ID NO: 10465 - RNA, 51 nt, Artificial Sequence
  Description of Artificial Sequence: Synthetic oligonucleotide
gggaggacgaugcggauaaggagaagggugaaccgcagacgacucgcccga

SEQ ID NO: 10466 - RNA, 51 nt, Artificial Sequence
  Description of Artificial Sequence: Synthetic oligonucleotide
gggaggacgaugcggauagggagaaggguaaaccgcagacgacucgcccga

SEQ ID NO: 10467 - RNA, 51 nt, Artificial Sequence
  Description of Artificial Sequence: Synthetic oligonucleotide
gggaggacgaugcgguuggguguagggugguaaugcagacgacucgcccga

SEQ ID NO: 10468 - RNA, 51 nt, Artificial Sequence
  Description of Artificial Sequence: Synthetic oligonucleotide
gggaggacgaugcggguucaacagccgccuuugugcagacgacucgcccga

SEQ ID NO: 10469 - RNA, 51 nt, Artificial Sequence
  Description of Artificial Sequence: Synthetic oligonucleotide
gggaggacgaugcggauagggugaagggugaaccgcagacgacucgcccga

SEQ ID NO: 10470 - RNA, 51 nt, Artificial Sequence
  Description of Artificial Sequence: Synthetic oligonucleotide
gggaggacgaugcgguuuggggggugaugggaccgcagacgacucgcccga

SEQ ID NO: 10471 - RNA, 51 nt, Artificial Sequence
  Description of Artificial Sequence: Synthetic oligonucleotide
gggaggacgaugcgguucuuucguccccuuaugugcagacgacucgcccga

SEQ ID NO: 10472 - RNA, 51 nt, Artificial Sequence
  Description of Artificial Sequence: Synthetic oligonucleotide
gggaggacgaugcggcaaucaaacugucuuccccccagacgacucgcccga

SEQ ID NO: 10473 - RNA, 51 nt, Artificial Sequence
  Description of Artificial Sequence: Synthetic oligonucleotide
gggaggacgaugcggauccgcuucucccuuggcaccagacgacucgcccga

SEQ ID NO: 10474 - RNA, 51 nt, Artificial Sequence
  Description of Artificial Sequence: Synthetic oligonucleotide
gggaggacgaugcggugugcuguguacuauguguacagacgacucgcccga

SEQ ID NO: 10475 - RNA, 51 nt, Artificial Sequence
  Description of Artificial Sequence: Synthetic oligonucleotide
gggaggacgaugcgguuggguguaggguaauaccgcagacgacucgcccga

SEQ ID NO: 10476 - RNA, 51 nt, Artificial Sequence
  Description of Artificial Sequence: Synthetic oligonucleotide
gggaggacgaugcgggaggcguguucucuggucgccagacgacucgcccga

SEQ ID NO: 10477 - RNA, 51 nt, Artificial Sequence
  Description of Artificial Sequence: Synthetic oligonucleotide
gggaggacgaugcgguccaaauaugucgcgcuccccagacgacucgcccga

SEQ ID NO: 10478 - RNA, 51 nt, Artificial Sequence
  Description of Artificial Sequence: Synthetic oligonucleotide
gggaggacgaugcggguugaagggugaugggucggcagacgacucgcccga

SEQ ID NO: 10479 - RNA, 51 nt, Artificial Sequence
  Description of Artificial Sequence: Synthetic oligonucleotide
gggaggacgaugcggaaaugggacgauuucaccagcagacgacucgcccga

SEQ ID NO: 10480 - RNA, 51 nt, Artificial Sequence
  Description of Artificial Sequence: Synthetic oligonucleotide
gggaggacgaugcgguucgcuguucauacccaccccagacgacucgcccga

SEQ ID NO: 10481 - RNA, 51 nt, Artificial Sequence
  Description of Artificial Sequence: Synthetic oligonucleotide
gggaggacgaugcgguacggguuauaugcucugugcagacgacucgcccga

SEQ ID NO: 10482 - RNA, 51 nt, Artificial Sequence
  Description of Artificial Sequence: Synthetic oligonucleotide
gggaggacgaugcgguccggacgcauguucgacugcagacgacucgcccga

SEQ ID NO: 10483 - RNA, 51 nt, Artificial Sequence
  Description of Artificial Sequence: Synthetic oligonucleotide
gggaggacgaugcgggccgucauuuaauguggccccagacgacucgcccga

SEQ ID NO: 10484 - RNA, 51 nt, Artificial Sequence
  Description of Artificial Sequence: Synthetic oligonucleotide
gggaggacgaugcggugcacuuugggauuggcccacagacgacucgcccga

SEQ ID NO: 10485 - RNA, 51 nt, Artificial Sequence
  Description of Artificial Sequence: Synthetic oligonucleotide
gggaggacgaugcggucguuucccaugugugucaccagacgacucgcccga

SEQ ID NO: 10486 - RNA, 51 nt, Artificial Sequence
  Description of Artificial Sequence: Synthetic oligonucleotide
gggaggacgaugcggccauucgccuguaucgaguacagacgacucgcccga

SEQ ID NO: 10487 - RNA, 51 nt, Artificial Sequence
  Description of Artificial Sequence: Synthetic oligonucleotide
gggaggacgaugcgggagcucguucugugacgcugcagacgacucgcccga

SEQ ID NO: 10488 - RNA, 51 nt, Artificial Sequence
  Description of Artificial Sequence: Synthetic oligonucleotide
gggaggacgaugcggcacugaacugauggcuaccccagacgacucgcccga

SEQ ID NO: 10489 - RNA, 51 nt, Artificial Sequence
  Description of Artificial Sequence: Synthetic oligonucleotide
gggaggacgaugcggcacuucaucgaacgacuccccagacgacucgcccga

SEQ ID NO: 10490 - RNA, 51 nt, Artificial Sequence
  Description of Artificial Sequence: Synthetic oligonucleotide
gggaggacgaugcggcaucaaacggggugagugcccagacgacucgcccga

SEQ ID NO: 10491 - RNA, 52 nt, Artificial Sequence
  Description of Artificial Sequence: Synthetic oligonucleotide
gggaggacgaugcggaaagagcugagucgcugugcccagacgacucgcccga

SEQ ID NO: 10492 - RNA, 51 nt, Artificial Sequence
  Description of Artificial Sequence: Synthetic oligonucleotide
gggaggacgaugcgguuugcagggugauggguccccagacgacucgcccga

SEQ ID NO: 10493 - RNA, 51 nt, Artificial Sequence
  Description of Artificial Sequence: Synthetic oligonucleotide
gggaggacgaugcgguugggucuaggguguuaccgcagacgacucgcccga

SEQ ID NO: 10494 - RNA, 49 nt, Artificial Sequence
  Description of Artificial Sequence: Synthetic oligonucleotide
gggaggacgaugcggcgugucgcucggucugugcagacgacucgcccga

SEQ ID NO: 10495 - RNA, 51 nt, Artificial Sequence
  Description of Artificial Sequence: Synthetic oligonucleotide
gggaggacgaugcggugaaugcucuucuguugguacagacgacucgcccga

SEQ ID NO: 10496 - RNA, 51 nt, Artificial Sequence
  Description of Artificial Sequence: Synthetic oligonucleotide
gggaggacgaugcggaaacauguuacaagccgcuacagacgacucgcccga

SEQ ID NO: 10497 - RNA, 51 nt, Artificial Sequence
  Description of Artificial Sequence: Synthetic oligonucleotide
gggaggacgaugcggguugauguggguauucaccccagacgacucgcccga

SEQ ID NO: 10498 - RNA, 51 nt, Artificial Sequence
  Description of Artificial Sequence: Synthetic oligonucleotide
gggaggacgaugcggacaugcguacggacuugggccagacgacucgcccga

SEQ ID NO: 10499 - RNA, 51 nt, Artificial Sequence
  Description of Artificial Sequence: Synthetic oligonucleotide
gggaggacgaugcggauugaaggagggagggacugcagacgacucgcccga

SEQ ID NO: 10500 - RNA, 51 nt, Artificial Sequence
  Description of Artificial Sequence: Synthetic oligonucleotide
gggaggacgaugcggguuuaagggugauggguccgcagacgacucgcccga

SEQ ID NO: 10501 - RNA, 51 nt, Artificial Sequence
  Description of Artificial Sequence: Synthetic oligonucleotide
gggaggacgaugcgggaacaugacuucucuacccccagacgacucgcccga

SEQ ID NO: 10502 - RNA, 51 nt, Artificial Sequence
  Description of Artificial Sequence: Synthetic oligonucleotide
gggaggacgaugcggucauguccccuauguaccgccagacgacucgcccga

SEQ ID NO: 10503 - RNA, 51 nt, Artificial Sequence
  Description of Artificial Sequence: Synthetic oligonucleotide
gggaggacgaugcggugggccguagugcgucugugcagacgacucgcccga

SEQ ID NO: 10504 - RNA, 51 nt, Artificial Sequence
  Description of Artificial Sequence: Synthetic oligonucleotide
gggaggacgaugcggaauaaaguccgacuuggcugcagacgacucgcccga

SEQ ID NO: 10505 - RNA, 51 nt, Artificial Sequence
  Description of Artificial Sequence: Synthetic oligonucleotide
gggaggacgaugcggaccuauaauuagucugugugcagacgacucgcccga

SEQ ID NO: 10506 - RNA, 51 nt, Artificial Sequence
  Description of Artificial Sequence: Synthetic oligonucleotide
gggaggacgaugcgguugaugacuuauggcacaugcagacgacucgcccga

SEQ ID NO: 10507 - RNA, 51 nt, Artificial Sequence
  Description of Artificial Sequence: Synthetic oligonucleotide
gggaggacgaugcgguguagagagguaguuaucgucagacgacucgcccga

SEQ ID NO: 10508 - RNA, 51 nt, Artificial Sequence
  Description of Artificial Sequence: Synthetic oligonucleotide
gggaggacgaugcggauacggugugugcuuggccccagacgacucgcccga

SEQ ID NO: 10509 - RNA, 52 nt, Artificial Sequence
  Description of Artificial Sequence: Synthetic oligonucleotide
gggaggacgaugcgguuggguguaggguagguaccgcagacgacucgcccga

SEQ ID NO: 10510 - RNA, 51 nt, Artificial Sequence
  Description of Artificial Sequence: Synthetic oligonucleotide
gggaggacgaugcgggguggugaagggagguacugcagacgacucgcccga

SEQ ID NO: 10511 - RNA, 51 nt, Artificial Sequence
  Description of Artificial Sequence: Synthetic oligonucleotide
gggaggacgaugcggauuuaguccucggguugcugcagacgacucgcccga

SEQ ID NO: 10512 - RNA, 51 nt, Artificial Sequence
  Description of Artificial Sequence: Synthetic oligonucleotide
gggaggacgaugcggguagcacaagucugcuuggccagacgacucgcccga

SEQ ID NO: 10513 - RNA, 51 nt, Artificial Sequence
  Description of Artificial Sequence: Synthetic oligonucleotide
gggaggacgaugcgguuugaagagcgauggguccgcagacgacucgcccga

SEQ ID NO: 10514 - RNA, 51 nt, Artificial Sequence
  Description of Artificial Sequence: Synthetic oligonucleotide
gggaggacgaugcggugaucgucaguucuccugugcagacgacucgcccga

SEQ ID NO: 10515 - RNA, 51 nt, Artificial Sequence
  Description of Artificial Sequence: Synthetic oligonucleotide
gggaggacgaugcggucgagguaggaauggcgugccagacgacucgcccga

SEQ ID NO: 10516 - RNA, 51 nt, Artificial Sequence
  Description of Artificial Sequence: Synthetic oligonucleotide
gggaggacgaugcgguuggguguagggcgguaccccagacgacucgcccga

SEQ ID NO: 10517 - RNA, 51 nt, Artificial Sequence
  Description of Artificial Sequence: Synthetic oligonucleotide
gggaggacgaugcggucaccuaacgguuacaccaucagacgacucgcccga

SEQ ID NO: 10518 - RNA, 49 nt, Artificial Sequence
  Description of Artificial Sequence: Synthetic oligonucleotide
gggaggacgaugcggcggugaagggagguacugcagacgacucgcccga

SEQ ID NO: 10519 - RNA, 51 nt, Artificial Sequence
  Description of Artificial Sequence: Synthetic oligonucleotide
gggaggacgaugcgguuagcguucuucccgggugccagacgacucgcccga

SEQ ID NO: 10520 - RNA, 51 nt, Artificial Sequence
  Description of Artificial Sequence: Synthetic oligonucleotide
gggaggacgaugcggugauucguguacuccggccccagacgacucgcccga

SEQ ID NO: 10521 - RNA, 50 nt, Artificial Sequence
  Description of Artificial Sequence: Synthetic oligonucleotide
gggaggacgaugcgguuugaagggggaugguccgcagacgacucgcccga

SEQ ID NO: 10522 - RNA, 51 nt, Artificial Sequence
  Description of Artificial Sequence: Synthetic oligonucleotide
gggaggacgaugcggagaagaguugguugugcccccagacgacucgcccga

SEQ ID NO: 10523 - RNA, 51 nt, Artificial Sequence
  Description of Artificial Sequence: Synthetic oligonucleotide
gggaggacgaugcggacaccguggucccaauuggccagacgacucgcccga

SEQ ID NO: 10524 - RNA, 51 nt, Artificial Sequence
  Description of Artificial Sequence: Synthetic oligonucleotide
gggaggacgaugcgguacgagccgacugcguacgccagacgacucgcccga

SEQ ID NO: 10525 - RNA, 51 nt, Artificial Sequence
  Description of Artificial Sequence: Synthetic oligonucleotide
gggaggacgaugcgguguccguuucuccccguaaccagacgacucgcccga

SEQ ID NO: 10526 - RNA, 51 nt, Artificial Sequence
  Description of Artificial Sequence: Synthetic oligonucleotide
gggaggacgaugcggucugcggcguauugcaucaccagacgacucgcccga

SEQ ID NO: 10527 - RNA, 51 nt, Artificial Sequence
  Description of Artificial Sequence: Synthetic oligonucleotide
gggaggacgaugcgguucguuuggcgauacguguccagacgacucgcccga

SEQ ID NO: 10528 - RNA, 51 nt, Artificial Sequence
  Description of Artificial Sequence: Synthetic oligonucleotide
gggaggacgaugcgguuggguguagugcgguaccgcagacgacucgcccga

SEQ ID NO: 10529 - RNA, 51 nt, Artificial Sequence
  Description of Artificial Sequence: Synthetic oligonucleotide
gggaggacgaugcgggaugucauggcauguguggccagacgacucgcccga

SEQ ID NO: 10530 - RNA, 51 nt, Artificial Sequence
  Description of Artificial Sequence: Synthetic oligonucleotide
gggaggacgaugcggcagacuagacaaucagugugcagacgacucgcccga

SEQ ID NO: 10531 - RNA, 51 nt, Artificial Sequence
  Description of Artificial Sequence: Synthetic oligonucleotide
gggaggacgaugcgguuugaauugugauggguccgcagacgacucgcccga

SEQ ID NO: 10532 - RNA, 51 nt, Artificial Sequence
  Description of Artificial Sequence: Synthetic oligonucleotide
gggaggacgaugcggcaugggaccacaacucacugcagacgacucgcccga

SEQ ID NO: 10533 - RNA, 51 nt, Artificial Sequence
  Description of Artificial Sequence: Synthetic oligonucleotide
gggaggacgaugcggcauggauugacguugcugugcagacgacucgcccga

SEQ ID NO: 10534 - RNA, 51 nt, Artificial Sequence
  Description of Artificial Sequence: Synthetic oligonucleotide
gggaggacgaugcggcaguaugucugcauuggcugcagacgacucgcccga

SEQ ID NO: 10535 - RNA, 51 nt, Artificial Sequence
  Description of Artificial Sequence: Synthetic oligonucleotide
gggaggacgaugcgguauacggcggcguggggauacagacgacucgcccga

SEQ ID NO: 10536 - RNA, 51 nt, Artificial Sequence
  Description of Artificial Sequence: Synthetic oligonucleotide
gggaggacgaugcggaugaggaccauucaccacaccagacgacucgcccga

SEQ ID NO: 10537 - RNA, 51 nt, Artificial Sequence
  Description of Artificial Sequence: Synthetic oligonucleotide
gggaggacgaugcggugugcauauuuaacgcucugcagacgacucgcccga

SEQ ID NO: 10538 - RNA, 50 nt, Artificial Sequence
  Description of Artificial Sequence: Synthetic oligonucleotide
gggaggacgaugcgguuggcguagggugguaccgcagacgacucgcccga

SEQ ID NO: 10539 - RNA, 51 nt, Artificial Sequence
  Description of Artificial Sequence: Synthetic oligonucleotide
gggaggacgaugcggaccgugaucauagugcgccccagacgacucgcccga

SEQ ID NO: 10540 - RNA, 51 nt, Artificial Sequence
  Description of Artificial Sequence: Synthetic oligonucleotide
gggaggacgaugcggugaguucuuguaaggcuccucagacgacucgcccga

SEQ ID NO: 10541 - RNA, 51 nt, Artificial Sequence
  Description of Artificial Sequence: Synthetic oligonucleotide
gggaggacgaugcgguccggcuuacugauccgccacagacgacucgcccga

SEQ ID NO: 10542 - RNA, 51 nt, Artificial Sequence
  Description of Artificial Sequence: Synthetic oligonucleotide
gggaggacgaugcggccaucgcuaauaacccgcgccagacgacucgcccga

SEQ ID NO: 10543 - RNA, 51 nt, Artificial Sequence
  Description of Artificial Sequence: Synthetic oligonucleotide
gggaggacgaugcgggcauuguauguggggugguccagacgacucgcccga

SEQ ID NO: 10544 - RNA, 51 nt, Artificial Sequence
  Description of Artificial Sequence: Synthetic oligonucleotide
gggaggacgaugcggaugaucacguuaagccccugcagacgacucgcccga

SEQ ID NO: 10545 - RNA, 51 nt, Artificial Sequence
  Description of Artificial Sequence: Synthetic oligonucleotide
gggaggacgaugcggucuucaaccaaauguaugcccagacgacucgcccga

SEQ ID NO: 10546 - RNA, 51 nt, Artificial Sequence
  Description of Artificial Sequence: Synthetic oligonucleotide
gggaggacgaugcgguuugaagggugauggguuggcagacgacucgcccga

SEQ ID NO: 10547 - RNA, 51 nt, Artificial Sequence
  Description of Artificial Sequence: Synthetic oligonucleotide
gggaggacgaugcgguacuguuccgccccguuguacagacgacucgcccga

SEQ ID NO: 10548 - RNA, 51 nt, Artificial Sequence
  Description of Artificial Sequence: Synthetic oligonucleotide
gggaggacgaugcggucuuacgucgcugcagaccccagacgacucgcccga

SEQ ID NO: 10549 - RNA, 51 nt, Artificial Sequence
  Description of Artificial Sequence: Synthetic oligonucleotide
gggaggacgaugcggccgcguaaucaagccauguccagacgacucgcccga

SEQ ID NO: 10550 - RNA, 51 nt, Artificial Sequence
  Description of Artificial Sequence: Synthetic oligonucleotide
gggaggacgaugcggggagugugauucagcuugugcagacgacucgcccga

SEQ ID NO: 10551 - RNA, 51 nt, Artificial Sequence
  Description of Artificial Sequence: Synthetic oligonucleotide
gggaggacgaugcgggccuuucguucuucucuccccagacgacucgcccga

SEQ ID NO: 10552 - RNA, 51 nt, Artificial Sequence
  Description of Artificial Sequence: Synthetic oligonucleotide
gggaggacgaugcgguaugaucuugaaaugcugugcagacgacucgcccga

SEQ ID NO: 10553 - RNA, 51 nt, Artificial Sequence
  Description of Artificial Sequence: Synthetic oligonucleotide
gggaggacgaugcggaaauccuccaacguauuccccagacgacucgcccga

SEQ ID NO: 10554 - RNA, 50 nt, Artificial Sequence
  Description of Artificial Sequence: Synthetic oligonucleotide
gggaggacgaugcggaucuaacccgcaagugccgcagacgacucgcccga

SEQ ID NO: 10555 - RNA, 51 nt, Artificial Sequence
  Description of Artificial Sequence: Synthetic oligonucleotide
gggaggacgaugcggcaaucuauaggggauguguccagacgacucgcccga

SEQ ID NO: 10556 - RNA, 51 nt, Artificial Sequence
  Description of Artificial Sequence: Synthetic oligonucleotide
gggaggacgaugcgguucgguaaaauuggaugcugcagacgacucgcccga

SEQ ID NO: 10557 - RNA, 51 nt, Artificial Sequence
  Description of Artificial Sequence: Synthetic oligonucleotide
gggaggacgaugcgggaccuaucauaauacaccgccagacgacucgcccga

SEQ ID NO: 10558 - RNA, 50 nt, Artificial Sequence
  Description of Artificial Sequence: Synthetic oligonucleotide
gggaggacgaugcggcuauuggcgaaggguggugcagacgacucgcccga

SEQ ID NO: 10559 - RNA, 51 nt, Artificial Sequence
  Description of Artificial Sequence: Synthetic oligonucleotide
gggaggacgaugcggcucuggaugucagcugugugcagacgacucgcccga

SEQ ID NO: 10560 - RNA, 51 nt, Artificial Sequence
  Description of Artificial Sequence: Synthetic oligonucleotide
gggaggacgaugcggagcgcacaacccuuacgcgucagacgacucgcccga

SEQ ID NO: 10561 - RNA, 51 nt, Artificial Sequence
  Description of Artificial Sequence: Synthetic oligonucleotide
gggaggacgaugcggucacugcagauagcccgcugcagacgacucgcccga

SEQ ID NO: 10562 - RNA, 51 nt, Artificial Sequence
  Description of Artificial Sequence: Synthetic oligonucleotide
gggaggacgaugcggcuaucaggaaacgauguggccagacgacucgcccga

SEQ ID NO: 10563 - RNA, 51 nt, Artificial Sequence
  Description of Artificial Sequence: Synthetic oligonucleotide
gggaggacgaugcggauuccucucagcucacuccccagacgacucgcccga

SEQ ID NO: 10564 - RNA, 51 nt, Artificial Sequence
  Description of Artificial Sequence: Synthetic oligonucleotide
gggaggacgaugcgguccaucguuaugccguuccgcagacgacucgcccga

SEQ ID NO: 10565 - RNA, 51 nt, Artificial Sequence
  Description of Artificial Sequence: Synthetic oligonucleotide
gggaggacgaugcgguuagguguagggugguacugcagacgacucgcccga

SEQ ID NO: 10566 - RNA, 51 nt, Artificial Sequence
  Description of Artificial Sequence: Synthetic oligonucleotide
gggaggacgaugcgguaccguccaauuucacugcccagacgacucgcccga

SEQ ID NO: 10567 - RNA, 51 nt, Artificial Sequence
  Description of Artificial Sequence: Synthetic oligonucleotide
gggaggacgaugcgggaacugugaaaugucgccugcagacgacucgcccga

SEQ ID NO: 10568 - RNA, 51 nt, Artificial Sequence
  Description of Artificial Sequence: Synthetic oligonucleotide
gggaggacgaugcggucuggaauacaaccugugcccagacgacucgcccga

SEQ ID NO: 10569 - RNA, 51 nt, Artificial Sequence
  Description of Artificial Sequence: Synthetic oligonucleotide
gggaggacgaugcgggcaugguguuuguaggugugcagacgacucgcccga

SEQ ID NO: 10570 - RNA, 51 nt, Artificial Sequence
  Description of Artificial Sequence: Synthetic oligonucleotide
gggaggacgaugcggaaugugcuccgcuccauggucagacgacucgcccga

SEQ ID NO: 10571 - RNA, 51 nt, Artificial Sequence
  Description of Artificial Sequence: Synthetic oligonucleotide
gggaggacgaugcgggugucuaaggguugcgugcccagacgacucgcccga

SEQ ID NO: 10572 - RNA, 51 nt, Artificial Sequence
  Description of Artificial Sequence: Synthetic oligonucleotide
gggaggacgaugcggcuugacgucuuguucguccccagacgacucgcccga

SEQ ID NO: 10573 - RNA, 51 nt, Artificial Sequence
  Description of Artificial Sequence: Synthetic oligonucleotide
gggaggacgaugcgguuauuccguccuacgugccccagacgacucgcccga

SEQ ID NO: 10574 - RNA, 51 nt, Artificial Sequence
  Description of Artificial Sequence: Synthetic oligonucleotide
gggaggacgaugcggagcguaguuauggcgugggccagacgacucgcccga

SEQ ID NO: 10575 - RNA, 51 nt, Artificial Sequence
  Description of Artificial Sequence: Synthetic oligonucleotide
gggaggacgaugcggaccgcucguagauuugugcccagacgacucgcccga

SEQ ID NO: 10576 - RNA, 51 nt, Artificial Sequence
  Description of Artificial Sequence: Synthetic oligonucleotide
gggaggacgaugcgguacuauguguaguccaucugcagacgacucgcccga

SEQ ID NO: 10577 - RNA, 51 nt, Artificial Sequence
  Description of Artificial Sequence: Synthetic oligonucleotide
gggaggacgaugcgguugaucagagguggucuguacagacgacucgcccga

SEQ ID NO: 10578 - RNA, 51 nt, Artificial Sequence
  Description of Artificial Sequence: Synthetic oligonucleotide
gggaggacgaugcgguaacuugugcgaucgaugugcagacgacucgcccga

SEQ ID NO: 10579 - RNA, 51 nt, Artificial Sequence
  Description of Artificial Sequence: Synthetic oligonucleotide
gggaggacgaugcggugauuaacuuuaacugugugcagacgacucgcccga

SEQ ID NO: 10580 - RNA, 51 nt, Artificial Sequence
  Description of Artificial Sequence: Synthetic oligonucleotide
gggaggacgaugcggucggcuacguacaauguugccagacgacucgcccga

SEQ ID NO: 10581 - RNA, 51 nt, Artificial Sequence
  Description of Artificial Sequence: Synthetic oligonucleotide
gggaggacgaugcggcaggaacgucuguuuguccccagacgacucgcccga

SEQ ID NO: 10582 - RNA, 51 nt, Artificial Sequence
  Description of Artificial Sequence: Synthetic oligonucleotide
gggaggacgaugcgguagagauaagaaguugcugucagacgacucgcccga

SEQ ID NO: 10583 - RNA, 51 nt, Artificial Sequence
  Description of Artificial Sequence: Synthetic oligonucleotide
gggaggacgaugcgguaagucaucuauacgcuccccagacgacucgcccga

SEQ ID NO: 10584 - RNA, 51 nt, Artificial Sequence
  Description of Artificial Sequence: Synthetic oligonucleotide
gggaggacgaugcggucauccuccuguccugugugcagacgacucgcccga

SEQ ID NO: 10585 - RNA, 51 nt, Artificial Sequence
  Description of Artificial Sequence: Synthetic oligonucleotide
gggaggacgaugcggaacucgagucgccauuugugcagacgacucgcccga

SEQ ID NO: 10586 - RNA, 51 nt, Artificial Sequence
  Description of Artificial Sequence: Synthetic oligonucleotide
gggaggacgaugcgguuugaagggugaugggggcgcagacgacucgcccga

SEQ ID NO: 10587 - RNA, 51 nt, Artificial Sequence
  Description of Artificial Sequence: Synthetic oligonucleotide
gggaggacgaugcggauagggagaaggguuaaccgcagacgacucgcccga

SEQ ID NO: 10588 - RNA, 52 nt, Artificial Sequence
  Description of Artificial Sequence: Synthetic oligonucleotide
gggaggacgaugcggguccugucgucuguucgucaccagacgacucgcccga

SEQ ID NO: 10589 - RNA, 51 nt, Artificial Sequence
  Description of Artificial Sequence: Synthetic oligonucleotide
gggaggacgaugcggucucuguggauuuugcaccccagacgacucgcccga

SEQ ID NO: 10590 - RNA, 51 nt, Artificial Sequence
  Description of Artificial Sequence: Synthetic oligonucleotide
gggaggacgaugcggcauacaugcgucucuaccgucagacgacucgcccga

SEQ ID NO: 10591 - RNA, 49 nt, Artificial Sequence
  Description of Artificial Sequence: Synthetic oligonucleotide
gggaggacgaugcggauuggugaagggauacugcagacgacucgcccga

SEQ ID NO: 10592 - RNA, 50 nt, Artificial Sequence
  Description of Artificial Sequence: Synthetic oligonucleotide
gggaggacgaugcgguucaagggugauggguccgcagacgacucgcccga

SEQ ID NO: 10593 - RNA, 51 nt, Artificial Sequence
  Description of Artificial Sequence: Synthetic oligonucleotide
gggaggacgaugcggcuuagugucucugguaugaccagacgacucgcccga

SEQ ID NO: 10594 - RNA, 51 nt, Artificial Sequence
  Description of Artificial Sequence: Synthetic oligonucleotide
gggaggacgaugcgguggaccuuagacagcccguccagacgacucgcccga

SEQ ID NO: 10595 - RNA, 51 nt, Artificial Sequence
  Description of Artificial Sequence: Synthetic oligonucleotide
gggaggacgaugcggccgcacgucuuuucguaccgcagacgacucgcccga

SEQ ID NO: 10596 - RNA, 51 nt, Artificial Sequence
  Description of Artificial Sequence: Synthetic oligonucleotide
gggaggacgaugcgguuugaagggugauuggcccgcagacgacucgcccga

SEQ ID NO: 10597 - RNA, 51 nt, Artificial Sequence
  Description of Artificial Sequence: Synthetic oligonucleotide
gggaggacgaugcggcaacgcaucaaguugugcgccagacgacucgcccga

SEQ ID NO: 10598 - RNA, 50 nt, Artificial Sequence
  Description of Artificial Sequence: Synthetic oligonucleotide
gggaggacgaugcgguuugaaggguggggguccgcagacgacucgcccga

SEQ ID NO: 10599 - RNA, 51 nt, Artificial Sequence
  Description of Artificial Sequence: Synthetic oligonucleotide
gggaggacgaugcggaaacuccuagucaugugccccagacgacucgcccga

SEQ ID NO: 10600 - RNA, 50 nt, Artificial Sequence
  Description of Artificial Sequence: Synthetic oligonucleotide
gggaggacgaugcgguccugucgucuuugcgucccagacgacucgcccga

SEQ ID NO: 10601 - RNA, 51 nt, Artificial Sequence
  Description of Artificial Sequence: Synthetic oligonucleotide
gggaggacgaugcgggucacuuaacacuaauguaccagacgacucgcccga

SEQ ID NO: 10602 - RNA, 51 nt, Artificial Sequence
  Description of Artificial Sequence: Synthetic oligonucleotide
gggaggacgaugcggaacauugguauaaaugugcccagacgacucgcccga

SEQ ID NO: 10603 - RNA, 52 nt, Artificial Sequence
  Description of Artificial Sequence: Synthetic oligonucleotide
gggaggacgaugcgguccuucaagccuuccccuggccagacgacucgcccga

SEQ ID NO: 10604 - RNA, 51 nt, Artificial Sequence
  Description of Artificial Sequence: Synthetic oligonucleotide
gggaggacgaugcgguuugaagggugauggucccgcagacgacucgcccga

SEQ ID NO: 10605 - RNA, 51 nt, Artificial Sequence
  Description of Artificial Sequence: Synthetic oligonucleotide
gggaggacgaugcggacgugcgcugacccacuugccagacgacucgcccga

SEQ ID NO: 10606 - RNA, 51 nt, Artificial Sequence
  Description of Artificial Sequence: Synthetic oligonucleotide
gggaggacgaugcggacuuaguaacuauaaugcugcagacgacucgcccga

SEQ ID NO: 10607 - RNA, 51 nt, Artificial Sequence
  Description of Artificial Sequence: Synthetic oligonucleotide
gggaggacgaugcgguuugaagggugcugguuccgcagacgacucgcccga

SEQ ID NO: 10608 - RNA, 51 nt, Artificial Sequence
  Description of Artificial Sequence: Synthetic oligonucleotide
gggaggacgaugcgggaauauuugacaccgcgcugcagacgacucgcccga

SEQ ID NO: 10609 - RNA, 51 nt, Artificial Sequence
  Description of Artificial Sequence: Synthetic oligonucleotide
gggaggacgaugcgggccuuucggucuggccuccccagacgacucgcccga

SEQ ID NO: 10610 - RNA, 51 nt, Artificial Sequence
  Description of Artificial Sequence: Synthetic oligonucleotide
gggaggacgaugcggugaguccuggucacuguugucagacgacucgcccga

SEQ ID NO: 10611 - RNA, 51 nt, Artificial Sequence
  Description of Artificial Sequence: Synthetic oligonucleotide
gggaggacgaugcgguacgagcaugugacguugcccagacgacucgcccga

SEQ ID NO: 10612 - RNA, 51 nt, Artificial Sequence
  Description of Artificial Sequence: Synthetic oligonucleotide
gggaggacgaugcggcuggauugcacacuguacugcagacgacucgcccga

SEQ ID NO: 10613 - RNA, 51 nt, Artificial Sequence
  Description of Artificial Sequence: Synthetic oligonucleotide
gggaggacgaugcgguuugaaggguuauggggccgcagacgacucgcccga

SEQ ID NO: 10614 - RNA, 51 nt, Artificial Sequence
  Description of Artificial Sequence: Synthetic oligonucleotide
gggaggacgaugcggauagucugugauuguugcgucagacgacucgcccga

SEQ ID NO: 10615 - RNA, 51 nt, Artificial Sequence
  Description of Artificial Sequence: Synthetic oligonucleotide
gggaggacgaugcgguacgacauaaccucuuuggccagacgacucgcccga

SEQ ID NO: 10616 - RNA, 51 nt, Artificial Sequence
  Description of Artificial Sequence: Synthetic oligonucleotide
gggaggacgaugcggucguguuggauucuuccccccagacgacucgcccga

SEQ ID NO: 10617 - RNA, 51 nt, Artificial Sequence
  Description of Artificial Sequence: Synthetic oligonucleotide
gggaggacgaugcggcgucaacuugaacaugucgccagacgacucgcccga

SEQ ID NO: 10618 - RNA, 51 nt, Artificial Sequence
  Description of Artificial Sequence: Synthetic oligonucleotide
gggaggacgaugcggaacgccuccugugucgugaucagacgacucgcccga

SEQ ID NO: 10619 - RNA, 51 nt, Artificial Sequence
  Description of Artificial Sequence: Synthetic oligonucleotide
gggaggacgaugcggugacucgucuguuucgucuccagacgacucgcccga

SEQ ID NO: 10620 - RNA, 51 nt, Artificial Sequence
  Description of Artificial Sequence: Synthetic oligonucleotide
gggaggacgaugcggaccgaaccuaucgcuagcugcagacgacucgcccga

SEQ ID NO: 10621 - RNA, 51 nt, Artificial Sequence
  Description of Artificial Sequence: Synthetic oligonucleotide
gggaggacgaugcgguacguaaugaaauacugccccagacgacucgcccga

SEQ ID NO: 10622 - RNA, 51 nt, Artificial Sequence
  Description of Artificial Sequence: Synthetic oligonucleotide
gggaggacgaugcgguugauucgaggugacagccccagacgacucgcccga

SEQ ID NO: 10623 - RNA, 51 nt, Artificial Sequence
  Description of Artificial Sequence: Synthetic oligonucleotide
gggaggacgaugcggacagcuuaugacacccuccccagacgacucgcccga

SEQ ID NO: 10624 - RNA, 51 nt, Artificial Sequence
  Description of Artificial Sequence: Synthetic oligonucleotide
gggaggacgaugcggcucaacggaccauuggccagcagacgacucgcccga

SEQ ID NO: 10625 - RNA, 51 nt, Artificial Sequence
  Description of Artificial Sequence: Synthetic oligonucleotide
gggaggacgaugcggaucgacacgaguuguucgugcagacgacucgcccga

SEQ ID NO: 10626 - RNA, 51 nt, Artificial Sequence
  Description of Artificial Sequence: Synthetic oligonucleotide
gggaggacgaugcggaacgaucagcuacguugcgccagacgacucgcccga

SEQ ID NO: 10627 - RNA, 51 nt, Artificial Sequence
  Description of Artificial Sequence: Synthetic oligonucleotide
gggaggacgaugcggcguuuccucugguuaguccccagacgacucgcccga

SEQ ID NO: 10628 - RNA, 51 nt, Artificial Sequence
  Description of Artificial Sequence: Synthetic oligonucleotide
gggaggacgaugcgguuggguguggggagguaccgcagacgacucgcccga

SEQ ID NO: 10629 - RNA, 51 nt, Artificial Sequence
  Description of Artificial Sequence: Synthetic oligonucleotide
gggaggacgaugcgggccuuucguucuguccucuccagacgacucgcccga

SEQ ID NO: 10630 - RNA, 51 nt, Artificial Sequence
  Description of Artificial Sequence: Synthetic oligonucleotide
gggaggacgaugcgguacaacgcgaaaccucugugcagacgacucgcccga

SEQ ID NO: 10631 - RNA, 51 nt, Artificial Sequence
  Description of Artificial Sequence: Synthetic oligonucleotide
gggaggacgaugcggcuugaauggugauggguccgcagacgacucgcccga

SEQ ID NO: 10632 - RNA, 51 nt, Artificial Sequence
  Description of Artificial Sequence: Synthetic oligonucleotide
gggaggacgaugcggagaguguaucugcuauuaugcagacgacucgcccga

SEQ ID NO: 10633 - RNA, 51 nt, Artificial Sequence
  Description of Artificial Sequence: Synthetic oligonucleotide
gggaggacgaugcggaggacgacugcgauaugcugcagacgacucgcccga

SEQ ID NO: 10634 - RNA, 51 nt, Artificial Sequence
  Description of Artificial Sequence: Synthetic oligonucleotide
gggaggacgaugcggcuggauggcgcaagcaugugcagacgacucgcccga

SEQ ID NO: 10635 - RNA, 51 nt, Artificial Sequence
  Description of Artificial Sequence: Synthetic oligonucleotide
gggaggacgaugcggucggaaagcugcuuagccgccagacgacucgcccga

SEQ ID NO: 10636 - RNA, 51 nt, Artificial Sequence
  Description of Artificial Sequence: Synthetic oligonucleotide
gggaggacgaugcgggacccauccacuaaccugugcagacgacucgcccga

SEQ ID NO: 10637 - RNA, 51 nt, Artificial Sequence
  Description of Artificial Sequence: Synthetic oligonucleotide
gggaggacgaugcggccuuuguuucuggguaugcccagacgacucgcccga

SEQ ID NO: 10638 - RNA, 51 nt, Artificial Sequence
  Description of Artificial Sequence: Synthetic oligonucleotide
gggaggacgaugcgguaaguaguuugccaacuuggcagacgacucgcccga

SEQ ID NO: 10639 - RNA, 51 nt, Artificial Sequence
  Description of Artificial Sequence: Synthetic oligonucleotide
gggaggacgaugcggcgaguguucugauguccccccagacgacucgcccga

SEQ ID NO: 10640 - RNA, 52 nt, Artificial Sequence
  Description of Artificial Sequence: Synthetic oligonucleotide
gggaggacgaugcgguguugaagggugauggguccucagacgacucgcccga

SEQ ID NO: 10641 - RNA, 51 nt, Artificial Sequence
  Description of Artificial Sequence: Synthetic oligonucleotide
gggaggacgaugcgguuaccuccguuuuguggccccagacgacucgcccga

SEQ ID NO: 10642 - RNA, 51 nt, Artificial Sequence
  Description of Artificial Sequence: Synthetic oligonucleotide
gggaggacgaugcggcgguggauguugucugugugcagacgacucgcccga

SEQ ID NO: 10643 - RNA, 51 nt, Artificial Sequence
  Description of Artificial Sequence: Synthetic oligonucleotide
gggaggacgaugcggggcccauuagucagucugugcagacgacucgcccga

SEQ ID NO: 10644 - RNA, 51 nt, Artificial Sequence
  Description of Artificial Sequence: Synthetic oligonucleotide
gggaggacgaugcggcguuuccucugguucguuuccagacgacucgcccga

SEQ ID NO: 10645 - RNA, 51 nt, Artificial Sequence
  Description of Artificial Sequence: Synthetic oligonucleotide
gggaggacgaugcgguuugggguuuuccggugccccagacgacucgcccga

SEQ ID NO: 10646 - RNA, 51 nt, Artificial Sequence
  Description of Artificial Sequence: Synthetic oligonucleotide
gggaggacgaugcgggcgaauacagcucuuggugccagacgacucgcccga

SEQ ID NO: 10647 - RNA, 51 nt, Artificial Sequence
  Description of Artificial Sequence: Synthetic oligonucleotide
gggaggacgaugcgguggucguguguacgucuggccagacgacucgcccga

SEQ ID NO: 10648 - RNA, 51 nt, Artificial Sequence
  Description of Artificial Sequence: Synthetic oligonucleotide
gggaggacgaugcggacguccuuucuauggcugugcagacgacucgcccga

SEQ ID NO: 10649 - RNA, 51 nt, Artificial Sequence
  Description of Artificial Sequence: Synthetic oligonucleotide
gggaggacgaugcggacgugguguaggggggaguccagacgacucgcccga

SEQ ID NO: 10650 - RNA, 51 nt, Artificial Sequence
  Description of Artificial Sequence: Synthetic oligonucleotide
gggaggacgaugcggcaugcaaugaguggcaccugcagacgacucgcccga

SEQ ID NO: 10651 - RNA, 50 nt, Artificial Sequence
  Description of Artificial Sequence: Synthetic oligonucleotide
gggaggacgaugcggagcugguaaacugucgccgcagacgacucgcccga

SEQ ID NO: 10652 - RNA, 51 nt, Artificial Sequence
  Description of Artificial Sequence: Synthetic oligonucleotide
gggaggacgaugcgggugucguacuggcguuggugcagacgacucgcccga

SEQ ID NO: 10653 - RNA, 51 nt, Artificial Sequence
  Description of Artificial Sequence: Synthetic oligonucleotide
gggaggacgaugcgguuugacgugugauggguccgcagacgacucgcccga

SEQ ID NO: 10654 - RNA, 51 nt, Artificial Sequence
  Description of Artificial Sequence: Synthetic oligonucleotide
gggaggacgaugcggcaaaguauagacuguggaugcagacgacucgcccga

SEQ ID NO: 10655 - RNA, 51 nt, Artificial Sequence
  Description of Artificial Sequence: Synthetic oligonucleotide
gggaggacgaugcgguuugaggggugaugggucggcagacgacucgcccga

SEQ ID NO: 10656 - RNA, 51 nt, Artificial Sequence
  Description of Artificial Sequence: Synthetic oligonucleotide
gggaggacgaugcgguggguucuaucgaccgugugcagacgacucgcccga

SEQ ID NO: 10657 - RNA, 51 nt, Artificial Sequence
  Description of Artificial Sequence: Synthetic oligonucleotide
gggaggacgaugcgguuucguguccacucaccccacagacgacucgcccga

SEQ ID NO: 10658 - RNA, 51 nt, Artificial Sequence
  Description of Artificial Sequence: Synthetic oligonucleotide
gggaggacgaugcgguaguaaaccucucguguagccagacgacucgcccga

SEQ ID NO: 10659 - RNA, 51 nt, Artificial Sequence
  Description of Artificial Sequence: Synthetic oligonucleotide
gggaggacgaugcgguugggugggggaugggaccgcagacgacucgcccga

SEQ ID NO: 10660 - RNA, 51 nt, Artificial Sequence
  Description of Artificial Sequence: Synthetic oligonucleotide
gggaggacgaugcggaaccgcacagugaccagccccagacgacucgcccga

SEQ ID NO: 10661 - RNA, 51 nt, Artificial Sequence
  Description of Artificial Sequence: Synthetic oligonucleotide
gggaggacgaugcggacucaaagucucccguucuccagacgacucgcccga

SEQ ID NO: 10662 - RNA, 51 nt, Artificial Sequence
  Description of Artificial Sequence: Synthetic oligonucleotide
gggaggacgaugcgggagaacaaugguguguuugccagacgacucgcccga

SEQ ID NO: 10663 - RNA, 51 nt, Artificial Sequence
  Description of Artificial Sequence: Synthetic oligonucleotide
gggaggacgaugcgguuuaggguuaaugcgggguccagacgacucgcccga

SEQ ID NO: 10664 - RNA, 51 nt, Artificial Sequence
  Description of Artificial Sequence: Synthetic oligonucleotide
gggaggacgaugcggucauggcagcacccgagcugcagacgacucgcccga

SEQ ID NO: 10665 - RNA, 51 nt, Artificial Sequence
  Description of Artificial Sequence: Synthetic oligonucleotide
gggaggacgaugcgguuugaaggguguugggucagcagacgacucgcccga

SEQ ID NO: 10666 - RNA, 51 nt, Artificial Sequence
  Description of Artificial Sequence: Synthetic oligonucleotide
gggaggacgaugcgguuggguguagagagguaccgcagacgacucgcccga

SEQ ID NO: 10667 - RNA, 51 nt, Artificial Sequence
  Description of Artificial Sequence: Synthetic oligonucleotide
gggaggacgaugcggguucuccggccgauuguggccagacgacucgcccga

SEQ ID NO: 10668 - RNA, 51 nt, Artificial Sequence
  Description of Artificial Sequence: Synthetic oligonucleotide
gggaggacgaugcggccugguaaccgauaaugccccagacgacucgcccga

SEQ ID NO: 10669 - RNA, 51 nt, Artificial Sequence
  Description of Artificial Sequence: Synthetic oligonucleotide
gggaggacgaugcggaaacgagcgaccgucaccuacagacgacucgcccga

SEQ ID NO: 10670 - RNA, 51 nt, Artificial Sequence
  Description of Artificial Sequence: Synthetic oligonucleotide
gggaggacgaugcgguaagucuuaccaaucgugugcagacgacucgcccga

SEQ ID NO: 10671 - RNA, 51 nt, Artificial Sequence
  Description of Artificial Sequence: Synthetic oligonucleotide
gggaggacgaugcggcuaagaaccuaacguccaugcagacgacucgcccga

SEQ ID NO: 10672 - RNA, 51 nt, Artificial Sequence
  Description of Artificial Sequence: Synthetic oligonucleotide
gggaggacgaugcggcauaccucguccagacugugcagacgacucgcccga

SEQ ID NO: 10673 - RNA, 51 nt, Artificial Sequence
  Description of Artificial Sequence: Synthetic oligonucleotide
gggaggacgaugcggaccacacacuacgcgagcugcagacgacucgcccga

SEQ ID NO: 10674 - RNA, 51 nt, Artificial Sequence
  Description of Artificial Sequence: Synthetic oligonucleotide
gggaggacgaugcgguacugcgcuguacucguccccagacgacucgcccga

SEQ ID NO: 10675 - RNA, 51 nt, Artificial Sequence
  Description of Artificial Sequence: Synthetic oligonucleotide
gggaggacgaugcggcacaggagaagggagguugccagacgacucgcccga

SEQ ID NO: 10676 - RNA, 51 nt, Artificial Sequence
  Description of Artificial Sequence: Synthetic oligonucleotide
gggaggacgaugcggagccgaucuugccguuugcccagacgacucgcccga

SEQ ID NO: 10677 - RNA, 51 nt, Artificial Sequence
  Description of Artificial Sequence: Synthetic oligonucleotide
gggaggacgaugcggcauugacuuccguugccccccagacgacucgcccga

SEQ ID NO: 10678 - RNA, 51 nt, Artificial Sequence
  Description of Artificial Sequence: Synthetic oligonucleotide
gggaggacgaugcggacggguacuuggucugugugcagacgacucgcccga

SEQ ID NO: 10679 - RNA, 51 nt, Artificial Sequence
  Description of Artificial Sequence: Synthetic oligonucleotide
gggaggacgaugcgguaacugucgacaaccccguccagacgacucgcccga

SEQ ID NO: 10680 - RNA, 51 nt, Artificial Sequence
  Description of Artificial Sequence: Synthetic oligonucleotide
gggaggacgaugcgguuggaaggaggauggguccgcagacgacucgcccga

SEQ ID NO: 10681 - RNA, 51 nt, Artificial Sequence
  Description of Artificial Sequence: Synthetic oligonucleotide
gggaggacgaugcgguucgaaggaugauggguccgcagacgacucgcccga

SEQ ID NO: 10682 - RNA, 51 nt, Artificial Sequence
  Description of Artificial Sequence: Synthetic oligonucleotide
gggaggacgaugcgguauuaaugcuaaaguguccccagacgacucgcccga

SEQ ID NO: 10683 - RNA, 51 nt, Artificial Sequence
  Description of Artificial Sequence: Synthetic oligonucleotide
gggaggacgaugcggguggguguaggguguuaccgcagacgacucgcccga

SEQ ID NO: 10684 - RNA, 51 nt, Artificial Sequence
  Description of Artificial Sequence: Synthetic oligonucleotide
gggaggacgaugcggugaaaaacacauuguugcaucagacgacucgcccga

SEQ ID NO: 10685 - RNA, 51 nt, Artificial Sequence
  Description of Artificial Sequence: Synthetic oligonucleotide
gggaggacgaugcgguugguuguagggggguaccgcagacgacucgcccga

SEQ ID NO: 10686 - RNA, 49 nt, Artificial Sequence
  Description of Artificial Sequence: Synthetic oligonucleotide
gggaggacgaugcggacgccgcuauucacuccccagacgacucgcccga

SEQ ID NO: 10687 - RNA, 51 nt, Artificial Sequence
  Description of Artificial Sequence: Synthetic oligonucleotide
gggaggacgaugcggaaacaggcaaaaagcuuguacagacgacucgcccga

SEQ ID NO: 10688 - RNA, 51 nt, Artificial Sequence
  Description of Artificial Sequence: Synthetic oligonucleotide
gggaggacgaugcggucaugugagaacgauccccccagacgacucgcccga

SEQ ID NO: 10689 - RNA, 51 nt, Artificial Sequence
  Description of Artificial Sequence: Synthetic oligonucleotide
gggaggacgaugcggcgaccucugaguugcgugaccagacgacucgcccga

SEQ ID NO: 10690 - RNA, 51 nt, Artificial Sequence
  Description of Artificial Sequence: Synthetic oligonucleotide
gggaggacgaugcggucuuuucucccugcccucuccagacgacucgcccga

SEQ ID NO: 10691 - RNA, 51 nt, Artificial Sequence
  Description of Artificial Sequence: Synthetic oligonucleotide
gggaggacgaugcggaccuucgcagcugguuucgccagacgacucgcccga

SEQ ID NO: 10692 - RNA, 51 nt, Artificial Sequence
  Description of Artificial Sequence: Synthetic oligonucleotide
gggaggacgaugcggguauacagaaauuugcccgucagacgacucgcccga

SEQ ID NO: 10693 - RNA, 51 nt, Artificial Sequence
  Description of Artificial Sequence: Synthetic oligonucleotide
gggaggacgaugcgguccgccgaguuuucccccuacagacgacucgcccga

SEQ ID NO: 10694 - RNA, 51 nt, Artificial Sequence
  Description of Artificial Sequence: Synthetic oligonucleotide
gggaggacgaugcggcguaaaaagucgguggucgccagacgacucgcccga

SEQ ID NO: 10695 - RNA, 51 nt, Artificial Sequence
  Description of Artificial Sequence: Synthetic oligonucleotide
gggaggacgaugcgguucguagggugauggguccgcagacgacucgcccga

SEQ ID NO: 10696 - RNA, 51 nt, Artificial Sequence
  Description of Artificial Sequence: Synthetic oligonucleotide
gggaggacgaugcggccguaucuucucuguccccccagacgacucgcccga

SEQ ID NO: 10697 - RNA, 51 nt, Artificial Sequence
  Description of Artificial Sequence: Synthetic oligonucleotide
gggaggacgaugcggaauacagucucuuuucgccgcagacgacucgcccga

SEQ ID NO: 10698 - RNA, 51 nt, Artificial Sequence
  Description of Artificial Sequence: Synthetic oligonucleotide
gggaggacgaugcggcaaucaucgcaugucugggccagacgacucgcccga

SEQ ID NO: 10699 - RNA, 51 nt, Artificial Sequence
  Description of Artificial Sequence: Synthetic oligonucleotide
gggaggacgaugcgguccccuaauuucugucgccgcagacgacucgcccga

SEQ ID NO: 10700 - RNA, 51 nt, Artificial Sequence
  Description of Artificial Sequence: Synthetic oligonucleotide
gggaggacgaugcggccuggagagcaucguuggugcagacgacucgcccga

SEQ ID NO: 10701 - RNA, 51 nt, Artificial Sequence
  Description of Artificial Sequence: Synthetic oligonucleotide
gggaggacgaugcgguaccaauuaguuaugaccgccagacgacucgcccga

SEQ ID NO: 10702 - RNA, 51 nt, Artificial Sequence
  Description of Artificial Sequence: Synthetic oligonucleotide
gggaggacgaugcggaucuacacugaggugguguacagacgacucgcccga

SEQ ID NO: 10703 - RNA, 52 nt, Artificial Sequence
  Description of Artificial Sequence: Synthetic oligonucleotide
gggaggacgaugcgguugcgguguagggugguaccgcagacgacucgcccga

SEQ ID NO: 10704 - RNA, 51 nt, Artificial Sequence
  Description of Artificial Sequence: Synthetic oligonucleotide
gggaggacgaugcggucguugggucggugcugcaccagacgacucgcccga

SEQ ID NO: 10705 - RNA, 51 nt, Artificial Sequence
  Description of Artificial Sequence: Synthetic oligonucleotide
gggaggacgaugcggauugcucuucucugccgcaccagacgacucgcccga

SEQ ID NO: 10706 - RNA, 51 nt, Artificial Sequence
  Description of Artificial Sequence: Synthetic oligonucleotide
gggaggacgaugcggugaccugugucaugccccaccagacgacucgcccga

SEQ ID NO: 10707 - RNA, 51 nt, Artificial Sequence
  Description of Artificial Sequence: Synthetic oligonucleotide
gggaggacgaugcgguuggguguagugagguaccgcagacgacucgcccga

SEQ ID NO: 10708 - RNA, 51 nt, Artificial Sequence
  Description of Artificial Sequence: Synthetic oligonucleotide
gggaggacgaugcgguagguaacaaauuacaccugcagacgacucgcccga

SEQ ID NO: 10709 - RNA, 51 nt, Artificial Sequence
  Description of Artificial Sequence: Synthetic oligonucleotide
gggaggacgaugcgguuugaagugugauggggccgcagacgacucgcccga

SEQ ID NO: 10710 - RNA, 51 nt, Artificial Sequence
  Description of Artificial Sequence: Synthetic oligonucleotide
gggaggacgaugcgguuugguggaggaugggaccgcagacgacucgcccga

SEQ ID NO: 10711 - RNA, 51 nt, Artificial Sequence
  Description of Artificial Sequence: Synthetic oligonucleotide
gggaggacgaugcggauucacgaucugucgcugcccagacgacucgcccga

SEQ ID NO: 10712 - RNA, 51 nt, Artificial Sequence
  Description of Artificial Sequence: Synthetic oligonucleotide
gggaggacgaugcggguccuaguucugucccucaccagacgacucgcccga

SEQ ID NO: 10713 - RNA, 51 nt, Artificial Sequence
  Description of Artificial Sequence: Synthetic oligonucleotide
gggaggacgaugcggcaagggcgaaacccuaucugcagacgacucgcccga

SEQ ID NO: 10714 - RNA, 51 nt, Artificial Sequence
  Description of Artificial Sequence: Synthetic oligonucleotide
gggaggacgaugcgguuucuauggaugauuccgugcagacgacucgcccga

SEQ ID NO: 10715 - RNA, 51 nt, Artificial Sequence
  Description of Artificial Sequence: Synthetic oligonucleotide
gggaggacgaugcgguuugcagggugauggcuccgcagacgacucgcccga

SEQ ID NO: 10716 - RNA, 51 nt, Artificial Sequence
  Description of Artificial Sequence: Synthetic oligonucleotide
gggaggacgaugcggucgcuugcacaauuuuuggccagacgacucgcccga

SEQ ID NO: 10717 - RNA, 51 nt, Artificial Sequence
  Description of Artificial Sequence: Synthetic oligonucleotide
gggaggacgaugcggccacugucacucccuguccgcagacgacucgcccga

SEQ ID NO: 10718 - RNA, 51 nt, Artificial Sequence
  Description of Artificial Sequence: Synthetic oligonucleotide
gggaggacgaugcggaaaaaucuccuucaccggugcagacgacucgcccga

SEQ ID NO: 10719 - RNA, 51 nt, Artificial Sequence
  Description of Artificial Sequence: Synthetic oligonucleotide
gggaggacgaugcggaccaguaaccguacgcgcugcagacgacucgcccga

SEQ ID NO: 10720 - RNA, 51 nt, Artificial Sequence
  Description of Artificial Sequence: Synthetic oligonucleotide
gggaggacgaugcggccuacgaccaguacgugcugcagacgacucgcccga

SEQ ID NO: 10721 - RNA, 51 nt, Artificial Sequence
  Description of Artificial Sequence: Synthetic oligonucleotide
gggaggacgaugcggauugucuauguuuacauggccagacgacucgcccga

SEQ ID NO: 10722 - RNA, 51 nt, Artificial Sequence
  Description of Artificial Sequence: Synthetic oligonucleotide
gggaggacgaugcggugcgauacgacauuucuccccagacgacucgcccga

SEQ ID NO: 10723 - RNA, 51 nt, Artificial Sequence
  Description of Artificial Sequence: Synthetic oligonucleotide
gggaggacgaugcgguuggguguagagcgguaccgcagacgacucgcccga

SEQ ID NO: 10724 - RNA, 53 nt, Artificial Sequence
  Description of Artificial Sequence: Synthetic oligonucleotide
gggaggacgaugcgguuuuugaagggugauggguccucagacgacucgcccga

SEQ ID NO: 10725 - RNA, 51 nt, Artificial Sequence
  Description of Artificial Sequence: Synthetic oligonucleotide
gggaggacgaugcggcuaugacgaucaucccugcccagacgacucgcccga

SEQ ID NO: 10726 - RNA, 51 nt, Artificial Sequence
  Description of Artificial Sequence: Synthetic oligonucleotide
gggaggacgaugcggccgcacuuauaccaccgcugcagacgacucgcccga

SEQ ID NO: 10727 - RNA, 51 nt, Artificial Sequence
  Description of Artificial Sequence: Synthetic oligonucleotide
gggaggacgaugcggcguuaaaguaaugugggcgccagacgacucgcccga

SEQ ID NO: 10728 - RNA, 51 nt, Artificial Sequence
  Description of Artificial Sequence: Synthetic oligonucleotide
gggaggacgaugcgggaauugccuuccuguagccccagacgacucgcccga

SEQ ID NO: 10729 - RNA, 51 nt, Artificial Sequence
  Description of Artificial Sequence: Synthetic oligonucleotide
gggaggacgaugcgguuugauggagggugggaccgcagacgacucgcccga

SEQ ID NO: 10730 - RNA, 51 nt, Artificial Sequence
  Description of Artificial Sequence: Synthetic oligonucleotide
gggaggacgaugcgggucuucaggcuuaucguccccagacgacucgcccga

SEQ ID NO: 10731 - RNA, 51 nt, Artificial Sequence
  Description of Artificial Sequence: Synthetic oligonucleotide
gggaggacgaugcggacgagguccaaugguuugcccagacgacucgcccga

SEQ ID NO: 10732 - RNA, 50 nt, Artificial Sequence
  Description of Artificial Sequence: Synthetic oligonucleotide
gggaggacgaugcggcuauuggugaagggcggugcagacgacucgcccga

SEQ ID NO: 10733 - RNA, 50 nt, Artificial Sequence
  Description of Artificial Sequence: Synthetic oligonucleotide
gggaggacgaugcggcaucuuccugcucccuggccagacgacucgcccga

SEQ ID NO: 10734 - RNA, 51 nt, Artificial Sequence
  Description of Artificial Sequence: Synthetic oligonucleotide
gggaggacgaugcgguuucguuaauugucguugcacagacgacucgcccga

SEQ ID NO: 10735 - RNA, 51 nt, Artificial Sequence
  Description of Artificial Sequence: Synthetic oligonucleotide
gggaggacgaugcggguauagacauaggcucugugcagacgacucgcccga

SEQ ID NO: 10736 - RNA, 51 nt, Artificial Sequence
  Description of Artificial Sequence: Synthetic oligonucleotide
gggaggacgaugcggaacggugaugguccaguguccagacgacucgcccga

SEQ ID NO: 10737 - RNA, 50 nt, Artificial Sequence
  Description of Artificial Sequence: Synthetic oligonucleotide
gggaggacgaugcgguuugaagggugaugggccccagacgacucgcccga

SEQ ID NO: 10738 - RNA, 51 nt, Artificial Sequence
  Description of Artificial Sequence: Synthetic oligonucleotide
gggaggacgaugcggaccguuaagcuccccguugccagacgacucgcccga

SEQ ID NO: 10739 - RNA, 51 nt, Artificial Sequence
  Description of Artificial Sequence: Synthetic oligonucleotide
gggaggacgaugcgguaaacaucugcaucaccccccagacgacucgcccga

SEQ ID NO: 10740 - RNA, 51 nt, Artificial Sequence
  Description of Artificial Sequence: Synthetic oligonucleotide
gggaggacgaugcgguuugggaguaggguguuccgcagacgacucgcccga

SEQ ID NO: 10741 - RNA, 51 nt, Artificial Sequence
  Description of Artificial Sequence: Synthetic oligonucleotide
gggaggacgaugcggguugguguagggggguuccgcagacgacucgcccga

SEQ ID NO: 10742 - RNA, 51 nt, Artificial Sequence
  Description of Artificial Sequence: Synthetic oligonucleotide
gggaggacgaugcggaugcuuggaguagggaggugcagacgacucgcccga

SEQ ID NO: 10743 - RNA, 51 nt, Artificial Sequence
  Description of Artificial Sequence: Synthetic oligonucleotide
gggaggacgaugcggcauaggaguagggugguagccagacgacucgcccga

SEQ ID NO: 10744 - RNA, 51 nt, Artificial Sequence
  Description of Artificial Sequence: Synthetic oligonucleotide
gggaggacgaugcggaaaggaggaguugggaucugcagacgacucgcccga

SEQ ID NO: 10745 - RNA, 51 nt, Artificial Sequence
  Description of Artificial Sequence: Synthetic oligonucleotide
gggaggacgaugcggcuuauggaguaggguggugccagacgacucgcccga

SEQ ID NO: 10746 - RNA, 51 nt, Artificial Sequence
  Description of Artificial Sequence: Synthetic oligonucleotide
gggaggacgaugcggauucacuucuuuucuugccgcagacgacucgcccga

SEQ ID NO: 10747 - RNA, 51 nt, Artificial Sequence
  Description of Artificial Sequence: Synthetic oligonucleotide
gggaggacgaugcggauuuggaggaggagguuccgcagacgacucgcccga

SEQ ID NO: 10748 - RNA, 51 nt, Artificial Sequence
  Description of Artificial Sequence: Synthetic oligonucleotide
gggaggacgaugcgguuuguuuuucucuuuuuccgcagacgacucgcccga

SEQ ID NO: 10749 - RNA, 52 nt, Artificial Sequence
  Description of Artificial Sequence: Synthetic oligonucleotide
gggaggacgaugcgguuuauuucuuuccacguuccgcagacgacucgcccga

SEQ ID NO: 10750 - RNA, 51 nt, Artificial Sequence
  Description of Artificial Sequence: Synthetic oligonucleotide
gggaggacgaugcgguucuuuauuuuuucccuccgcagacgacucgcccga

SEQ ID NO: 10751 - RNA, 51 nt, Artificial Sequence
  Description of Artificial Sequence: Synthetic oligonucleotide
gggaggacgaugcggccuuuuacuuuuuuucuccgcagacgacucgcccga

SEQ ID NO: 10752 - RNA, 51 nt, Artificial Sequence
  Description of Artificial Sequence: Synthetic oligonucleotide
gggaggacgaugcgguuuuauucuuuuccgcuccgcagacgacucgcccga

SEQ ID NO: 10753 - RNA, 53 nt, Artificial Sequence
  Description of Artificial Sequence: Synthetic oligonucleotide
gggaggacgaugcggaauuauguguuuuuugugaccgcagacgacucgcccga

SEQ ID NO: 10754 - RNA, 51 nt, Artificial Sequence
  Description of Artificial Sequence: Synthetic oligonucleotide
gggaggacgaugcggaucuuuucuuucuucugccgcagacgacucgcccga

SEQ ID NO: 10755 - RNA, 51 nt, Artificial Sequence
  Description of Artificial Sequence: Synthetic oligonucleotide
gggaggacgaugcggcuuauggaguagggaggugccagacgacucgcccga

SEQ ID NO: 10756 - RNA, 51 nt, Artificial Sequence
  Description of Artificial Sequence: Synthetic oligonucleotide
gggaggacgaugcggucuuuucauguuucucuccgcagacgacucgcccga

SEQ ID NO: 10757 - RNA, 51 nt, Artificial Sequence
  Description of Artificial Sequence: Synthetic oligonucleotide
gggaggacgaugcgguuuuucuuuuccuuuguccgcagacgacucgcccga

SEQ ID NO: 10758 - RNA, 51 nt, Artificial Sequence
  Description of Artificial Sequence: Synthetic oligonucleotide
gggaggacgaugcggauuacucuucucuuuugccgcagacgacucgcccga

SEQ ID NO: 10759 - RNA, 51 nt, Artificial Sequence
  Description of Artificial Sequence: Synthetic oligonucleotide
gggaggacgaugcgguuuguuuuauuuuuuguccccagacgacucgcccga

SEQ ID NO: 10760 - RNA, 51 nt, Artificial Sequence
  Description of Artificial Sequence: Synthetic oligonucleotide
gggaggacgaugcggaaggguguaggguguucccgcagacgacucgcccga

SEQ ID NO: 10761 - RNA, 51 nt, Artificial Sequence
  Description of Artificial Sequence: Synthetic oligonucleotide
gggaggacgaugcggauuucuuuucucuguugccgcagacgacucgcccga

SEQ ID NO: 10762 - RNA, 51 nt, Artificial Sequence
  Description of Artificial Sequence: Synthetic oligonucleotide
gggaggacgaugcggauuccuuuucuuuuucuccgcagacgacucgcccga

SEQ ID NO: 10763 - RNA, 51 nt, Artificial Sequence
  Description of Artificial Sequence: Synthetic oligonucleotide
gggaggacgaugcgguuauuuuccuuuuucugccgcagacgacucgcccga

SEQ ID NO: 10764 - RNA, 51 nt, Artificial Sequence
  Description of Artificial Sequence: Synthetic oligonucleotide
gggaggacgaugcggauucuuuucucuuuucaccgcagacgacucgcccga

SEQ ID NO: 10765 - RNA, 51 nt, Artificial Sequence
  Description of Artificial Sequence: Synthetic oligonucleotide
gggaggacgaugcgguuuguuaauucuuguuuccgcagacgacucgcccga

SEQ ID NO: 10766 - RNA, 51 nt, Artificial Sequence
  Description of Artificial Sequence: Synthetic oligonucleotide
gggaggacgaugcggauuucuuuuccuuuuuaccgcagacgacucgcccga

SEQ ID NO: 10767 - RNA, 51 nt, Artificial Sequence
  Description of Artificial Sequence: Synthetic oligonucleotide
gggaggacgaugcggauucucuuucuuuuucaccgcagacgacucgcccga

SEQ ID NO: 10768 - RNA, 51 nt, Artificial Sequence
  Description of Artificial Sequence: Synthetic oligonucleotide
gggaggacgaugcggauuucucuucuucuuugccgcagacgacucgcccga

SEQ ID NO: 10769 - RNA, 51 nt, Artificial Sequence
  Description of Artificial Sequence: Synthetic oligonucleotide
gggaggacgaugcgguuuguuuauucuuuuuuccgcagacgacucgcccga

SEQ ID NO: 10770 - RNA, 51 nt, Artificial Sequence
  Description of Artificial Sequence: Synthetic oligonucleotide
gggaggacgaugcggaucuuucuuauuuucugccgcagacgacucgcccga

SEQ ID NO: 10771 - RNA, 51 nt, Artificial Sequence
  Description of Artificial Sequence: Synthetic oligonucleotide
gggaggacgaugcggucuuuuuaacuuuuucuccgcagacgacucgcccga

SEQ ID NO: 10772 - RNA, 51 nt, Artificial Sequence
  Description of Artificial Sequence: Synthetic oligonucleotide
gggaggacgaugcggacuuucuucucuucuugccgcagacgacucgcccga

SEQ ID NO: 10773 - RNA, 52 nt, Artificial Sequence
  Description of Artificial Sequence: Synthetic oligonucleotide
gggaggacgaugcggcuuucacuuuuuuucucuccgcagacgacucgcccga

SEQ ID NO: 10774 - RNA, 51 nt, Artificial Sequence
  Description of Artificial Sequence: Synthetic oligonucleotide
gggaggacgaugcggauuuucucuuuugcuugccgcagacgacucgcccga

SEQ ID NO: 10775 - RNA, 51 nt, Artificial Sequence
  Description of Artificial Sequence: Synthetic oligonucleotide
gggaggacgaugcgguaaggaggaguugggaaccgcagacgacucgcccga

SEQ ID NO: 10776 - RNA, 50 nt, Artificial Sequence
  Description of Artificial Sequence: Synthetic oligonucleotide
gggaggacgaugcggauucuugcuuuuuuugccgcagacgacucgcccga

SEQ ID NO: 10777 - RNA, 51 nt, Artificial Sequence
  Description of Artificial Sequence: Synthetic oligonucleotide
gggaggacgaugcgguuuuucauucccuuuuuccgcagacgacucgcccga

SEQ ID NO: 10778 - RNA, 51 nt, Artificial Sequence
  Description of Artificial Sequence: Synthetic oligonucleotide
gggaggacgaugcgguuuucacucucuucucuccgcagacgacucgcccga

SEQ ID NO: 10779 - RNA, 51 nt, Artificial Sequence
  Description of Artificial Sequence: Synthetic oligonucleotide
gggaggacgaugcggauuuucuucuucuuuuaccgcagacgacucgcccga

SEQ ID NO: 10780 - RNA, 51 nt, Artificial Sequence
  Description of Artificial Sequence: Synthetic oligonucleotide
gggaggacgaugcggucuuuacuuucucuuugccgcagacgacucgcccga

SEQ ID NO: 10781 - RNA, 51 nt, Artificial Sequence
  Description of Artificial Sequence: Synthetic oligonucleotide
gggaggacgaugcgguuucuugucuauuuuuuccgcagacgacucgcccga

SEQ ID NO: 10782 - RNA, 51 nt, Artificial Sequence
  Description of Artificial Sequence: Synthetic oligonucleotide
gggaggacgaugcggauuuucucuuuuuucugccgcagacgacucgcccga

SEQ ID NO: 10783 - RNA, 51 nt, Artificial Sequence
  Description of Artificial Sequence: Synthetic oligonucleotide
gggaggacgaugcggacuucucuugucuucuuccgcagacgacucgcccga

SEQ ID NO: 10784 - RNA, 51 nt, Artificial Sequence
  Description of Artificial Sequence: Synthetic oligonucleotide
gggaggacgaugcggucuuuuguuauuuucauccgcagacgacucgcccga

SEQ ID NO: 10785 - RNA, 51 nt, Artificial Sequence
  Description of Artificial Sequence: Synthetic oligonucleotide
gggaggacgaugcggcuuuucuucgcuuuuuaccgcagacgacucgcccga

SEQ ID NO: 10786 - RNA, 51 nt, Artificial Sequence
  Description of Artificial Sequence: Synthetic oligonucleotide
gggaggacgaugcgguuucucuuuuucucuuuccgcagacgacucgcccga

SEQ ID NO: 10787 - RNA, 52 nt, Artificial Sequence
  Description of Artificial Sequence: Synthetic oligonucleotide
gggaggacgaugcggcuuuauuuuuguuuuuugccccagacgacucgcccga

SEQ ID NO: 10788 - RNA, 51 nt, Artificial Sequence
  Description of Artificial Sequence: Synthetic oligonucleotide
gggaggacgaugcggcuucuucacuuuucccuccgcagacgacucgcccga

SEQ ID NO: 10789 - RNA, 51 nt, Artificial Sequence
  Description of Artificial Sequence: Synthetic oligonucleotide
gggaggacgaugcggcuuuuucuucucuuguuccgcagacgacucgcccga

SEQ ID NO: 10790 - RNA, 51 nt, Artificial Sequence
  Description of Artificial Sequence: Synthetic oligonucleotide
gggaggacgaugcggauucuucuauuuucucaccgcagacgacucgcccga

SEQ ID NO: 10791 - RNA, 51 nt, Artificial Sequence
  Description of Artificial Sequence: Synthetic oligonucleotide
gggaggacgaugcggucuuauuuuucucuucuccgcagacgacucgcccga

SEQ ID NO: 10792 - RNA, 51 nt, Artificial Sequence
  Description of Artificial Sequence: Synthetic oligonucleotide
gggaggacgaugcgguuuugucauuucuuguuccgcagacgacucgcccga

SEQ ID NO: 10793 - RNA, 51 nt, Artificial Sequence
  Description of Artificial Sequence: Synthetic oligonucleotide
gggaggacgaugcgguuuauuuucucguuguugugcagacgacucgcccga

SEQ ID NO: 10794 - RNA, 51 nt, Artificial Sequence
  Description of Artificial Sequence: Synthetic oligonucleotide
gggaggacgaugcggauuuuucucuacuuucaccgcagacgacucgcccga

SEQ ID NO: 10795 - RNA, 51 nt, Artificial Sequence
  Description of Artificial Sequence: Synthetic oligonucleotide
gggaggacgaugcgguucauuuucuuuucucuccgcagacgacucgcccga

SEQ ID NO: 10796 - RNA, 51 nt, Artificial Sequence
  Description of Artificial Sequence: Synthetic oligonucleotide
gggaggacgaugcggagagguguagggagguuccgcagacgacucgcccga

SEQ ID NO: 10797 - RNA, 51 nt, Artificial Sequence
  Description of Artificial Sequence: Synthetic oligonucleotide
gggaggacgaugcgguuuuuuaugguuuguuuccgcagacgacucgcccga

SEQ ID NO: 10798 - RNA, 51 nt, Artificial Sequence
  Description of Artificial Sequence: Synthetic oligonucleotide
gggaggacgaugcggacuuuuuuugucuucugccgcagacgacucgcccga

SEQ ID NO: 10799 - RNA, 52 nt, Artificial Sequence
  Description of Artificial Sequence: Synthetic oligonucleotide
gggaggacgaugcggguuuucuuguuucuuguuccgcagacgacucgcccga

SEQ ID NO: 10800 - RNA, 51 nt, Artificial Sequence
  Description of Artificial Sequence: Synthetic oligonucleotide
gggaggacgaugcggcuuuuugcucuuuuucuccgcagacgacucgcccga

SEQ ID NO: 10801 - RNA, 51 nt, Artificial Sequence
  Description of Artificial Sequence: Synthetic oligonucleotide
gggaggacgaugcggcuuuucuuucucuuuuuccgcagacgacucgcccga

SEQ ID NO: 10802 - RNA, 51 nt, Artificial Sequence
  Description of Artificial Sequence: Synthetic oligonucleotide
gggaggacgaugcggaucuuuauuuuuucucuccgcagacgacucgcccga

SEQ ID NO: 10803 - RNA, 51 nt, Artificial Sequence
  Description of Artificial Sequence: Synthetic oligonucleotide
gggaggacgaugcgguucacuuuuuccucauuccgcagacgacucgcccga

SEQ ID NO: 10804 - RNA, 51 nt, Artificial Sequence
  Description of Artificial Sequence: Synthetic oligonucleotide
gggaggacgaugcggacucuuucuucucuuugccgcagacgacucgcccga

SEQ ID NO: 10805 - RNA, 51 nt, Artificial Sequence
  Description of Artificial Sequence: Synthetic oligonucleotide
gggaggacgaugcggauuccuuuucuccuuugccgcagacgacucgcccga

SEQ ID NO: 10806 - RNA, 50 nt, Artificial Sequence
  Description of Artificial Sequence: Synthetic oligonucleotide
gggaggacgaugcgguccugucgucuuucguccccagacgacucgcccga

SEQ ID NO: 10807 - RNA, 51 nt, Artificial Sequence
  Description of Artificial Sequence: Synthetic oligonucleotide
gggaggacgaugcggacuuuacucuucuuuuaccgcagacgacucgcccga

SEQ ID NO: 10808 - RNA, 51 nt, Artificial Sequence
  Description of Artificial Sequence: Synthetic oligonucleotide
gggaggacgaugcggcuucuuuaaauuucccuccgcagacgacucgcccga

SEQ ID NO: 10809 - RNA, 51 nt, Artificial Sequence
  Description of Artificial Sequence: Synthetic oligonucleotide
gggaggacgaugcgguauuuuccuuguuuucuccgcagacgacucgcccga

SEQ ID NO: 10810 - RNA, 51 nt, Artificial Sequence
  Description of Artificial Sequence: Synthetic oligonucleotide
gggaggacgaugcgguuuucuuucuauucuuuccgcagacgacucgcccga

SEQ ID NO: 10811 - RNA, 51 nt, Artificial Sequence
  Description of Artificial Sequence: Synthetic oligonucleotide
gggaggacgaugcgguuuuuguucccuuuugcccgcagacgacucgcccga

SEQ ID NO: 10812 - RNA, 51 nt, Artificial Sequence
  Description of Artificial Sequence: Synthetic oligonucleotide
gggaggacgaugcgguggguguagggagguaaccgcagacgacucgcccga

SEQ ID NO: 10813 - RNA, 51 nt, Artificial Sequence
  Description of Artificial Sequence: Synthetic oligonucleotide
gggaggacgaugcggacuuuuuucucuccuuuccgcagacgacucgcccga

SEQ ID NO: 10814 - RNA, 51 nt, Artificial Sequence
  Description of Artificial Sequence: Synthetic oligonucleotide
gggaggacgaugcgguuucuuuccauuucuugccgcagacgacucgcccga

SEQ ID NO: 10815 - RNA, 51 nt, Artificial Sequence
  Description of Artificial Sequence: Synthetic oligonucleotide
gggaggacgaugcggauuauuuacuuuuugccccgcagacgacucgcccga

SEQ ID NO: 10816 - RNA, 51 nt, Artificial Sequence
  Description of Artificial Sequence: Synthetic oligonucleotide
gggaggacgaugcgguuucuuucguuuucucuccgcagacgacucgcccga

SEQ ID NO: 10817 - RNA, 51 nt, Artificial Sequence
  Description of Artificial Sequence: Synthetic oligonucleotide
gggaggacgaugcggucuuuucuucucuucuaccgcagacgacucgcccga

SEQ ID NO: 10818 - RNA, 51 nt, Artificial Sequence
  Description of Artificial Sequence: Synthetic oligonucleotide
gggaggacgaugcgguuucuuuuacuuucuuuccgcagacgacucgcccga

SEQ ID NO: 10819 - RNA, 51 nt, Artificial Sequence
  Description of Artificial Sequence: Synthetic oligonucleotide
gggaggacgaugcggaccuuuucuuuccuauuccgcagacgacucgcccga

SEQ ID NO: 10820 - RNA, 51 nt, Artificial Sequence
  Description of Artificial Sequence: Synthetic oligonucleotide
gggaggacgaugcgguuuuauuuucuuuucccccgcagacgacucgcccga

SEQ ID NO: 10821 - RNA, 51 nt, Artificial Sequence
  Description of Artificial Sequence: Synthetic oligonucleotide
gggaggacgaugcgguuuuuugauucuuguuuccgcagacgacucgcccga

SEQ ID NO: 10822 - RNA, 51 nt, Artificial Sequence
  Description of Artificial Sequence: Synthetic oligonucleotide
gggaggacgaugcgguccugucggcuguucguccccagacgacucgcccga

SEQ ID NO: 10823 - RNA, 51 nt, Artificial Sequence
  Description of Artificial Sequence: Synthetic oligonucleotide
gggaggacgaugcgguucauuucuucucuucuccgcagacgacucgcccga

SEQ ID NO: 10824 - RNA, 51 nt, Artificial Sequence
  Description of Artificial Sequence: Synthetic oligonucleotide
gggaggacgaugcgguuugggaguaggguguuccccagacgacucgcccga

SEQ ID NO: 10825 - RNA, 51 nt, Artificial Sequence
  Description of Artificial Sequence: Synthetic oligonucleotide
gggaggacgaugcgguuuacuuuccucuuuugccgcagacgacucgcccga

SEQ ID NO: 10826 - RNA, 51 nt, Artificial Sequence
  Description of Artificial Sequence: Synthetic oligonucleotide
gggaggacgaugcggaucuuucuuuacucucaccgcagacgacucgcccga

SEQ ID NO: 10827 - RNA, 51 nt, Artificial Sequence
  Description of Artificial Sequence: Synthetic oligonucleotide
gggaggacgaugcgguuuuucuacuuucuuuuccgcagacgacucgcccga

SEQ ID NO: 10828 - RNA, 51 nt, Artificial Sequence
  Description of Artificial Sequence: Synthetic oligonucleotide
gggaggacgaugcgguuucuuuugcuuucucuccgcagacgacucgcccga

SEQ ID NO: 10829 - RNA, 51 nt, Artificial Sequence
  Description of Artificial Sequence: Synthetic oligonucleotide
gggaggacgaugcggucuuuuucuaccuuuuuccgcagacgacucgcccga

SEQ ID NO: 10830 - RNA, 50 nt, Artificial Sequence
  Description of Artificial Sequence: Synthetic oligonucleotide
gggaggacgaugcgguugggaguaggguguuccgcagacgacucgcccga

SEQ ID NO: 10831 - RNA, 51 nt, Artificial Sequence
  Description of Artificial Sequence: Synthetic oligonucleotide
gggaggacgaugcgguuuuacuauucuccuuuccgcagacgacucgcccga

SEQ ID NO: 10832 - RNA, 51 nt, Artificial Sequence
  Description of Artificial Sequence: Synthetic oligonucleotide
gggaggacgaugcggauuuuuucuuuccuuugccgcagacgacucgcccga

SEQ ID NO: 10833 - RNA, 51 nt, Artificial Sequence
  Description of Artificial Sequence: Synthetic oligonucleotide
gggaggacgaugcgguauuuucuucuuuuucuccgcagacgacucgcccga

SEQ ID NO: 10834 - RNA, 50 nt, Artificial Sequence
  Description of Artificial Sequence: Synthetic oligonucleotide
gggaggacgaugcgguccgucgucuguucguccccagacgacucgcccga

SEQ ID NO: 10835 - RNA, 51 nt, Artificial Sequence
  Description of Artificial Sequence: Synthetic oligonucleotide
gggaggacgaugcggucuuuuuguuucuuuauccgcagacgacucgcccga

SEQ ID NO: 10836 - RNA, 51 nt, Artificial Sequence
  Description of Artificial Sequence: Synthetic oligonucleotide
gggaggacgaugcgguuugauucucuuuguuuccgcagacgacucgcccga

SEQ ID NO: 10837 - RNA, 51 nt, Artificial Sequence
  Description of Artificial Sequence: Synthetic oligonucleotide
gggaggacgaugcgguccugucgucuggucguccccagacgacucgcccga

SEQ ID NO: 10838 - RNA, 51 nt, Artificial Sequence
  Description of Artificial Sequence: Synthetic oligonucleotide
gggaggacgaugcggauuuguuguucuuuuuaccgcagacgacucgcccga

SEQ ID NO: 10839 - RNA, 51 nt, Artificial Sequence
  Description of Artificial Sequence: Synthetic oligonucleotide
gggaggacgaugcgguucuucauuucucucugccgcagacgacucgcccga

SEQ ID NO: 10840 - RNA, 51 nt, Artificial Sequence
  Description of Artificial Sequence: Synthetic oligonucleotide
gggaggacgaugcgguuucacuuuuccauucuccgcagacgacucgcccga

SEQ ID NO: 10841 - RNA, 52 nt, Artificial Sequence
  Description of Artificial Sequence: Synthetic oligonucleotide
gggaggacgaugcgguccuugucgucuguucguccccagacgacucgcccga

SEQ ID NO: 10842 - RNA, 51 nt, Artificial Sequence
  Description of Artificial Sequence: Synthetic oligonucleotide
gggaggacgaugcgguuuuaaguuuuucguuugugcagacgacucgcccga

SEQ ID NO: 10843 - RNA, 51 nt, Artificial Sequence
  Description of Artificial Sequence: Synthetic oligonucleotide
gggaggacgaugcgggguuggaggugguggauccgcagacgacucgcccga

SEQ ID NO: 10844 - RNA, 51 nt, Artificial Sequence
  Description of Artificial Sequence: Synthetic oligonucleotide
gggaggacgaugcggacauucuucucucuuuaccgcagacgacucgcccga

SEQ ID NO: 10845 - RNA, 51 nt, Artificial Sequence
  Description of Artificial Sequence: Synthetic oligonucleotide
gggaggacgaugcggauucucuuuuaucccuaccgcagacgacucgcccga

SEQ ID NO: 10846 - RNA, 51 nt, Artificial Sequence
  Description of Artificial Sequence: Synthetic oligonucleotide
gggaggacgaugcggauuuucuuuccucuuuaccgcagacgacucgcccga

SEQ ID NO: 10847 - RNA, 51 nt, Artificial Sequence
  Description of Artificial Sequence: Synthetic oligonucleotide
gggaggacgaugcgguuuuucauaccuuuuuuccgcagacgacucgcccga

SEQ ID NO: 10848 - RNA, 51 nt, Artificial Sequence
  Description of Artificial Sequence: Synthetic oligonucleotide
gggaggacgaugcgguuuucuuuuccacuuuuccgcagacgacucgcccga

SEQ ID NO: 10849 - RNA, 51 nt, Artificial Sequence
  Description of Artificial Sequence: Synthetic oligonucleotide
gggaggacgaugcggauuaucuuuucuuuguuccgcagacgacucgcccga

SEQ ID NO: 10850 - RNA, 51 nt, Artificial Sequence
  Description of Artificial Sequence: Synthetic oligonucleotide
gggaggacgaugcgguuucuuacuuuuuucauccgcagacgacucgcccga

SEQ ID NO: 10851 - RNA, 51 nt, Artificial Sequence
  Description of Artificial Sequence: Synthetic oligonucleotide
gggaggacgaugcgguuucuucuuucuucuuuccgcagacgacucgcccga

SEQ ID NO: 10852 - RNA, 51 nt, Artificial Sequence
  Description of Artificial Sequence: Synthetic oligonucleotide
gggaggacgaugcgguccugucgucuguucguacccagacgacucgcccga

SEQ ID NO: 10853 - RNA, 51 nt, Artificial Sequence
  Description of Artificial Sequence: Synthetic oligonucleotide
gggaggacgaugcgguauugagagaggagguggugcagacgacucgcccga

SEQ ID NO: 10854 - RNA, 51 nt, Artificial Sequence
  Description of Artificial Sequence: Synthetic oligonucleotide
gggaggacgaugcgguuuuuguuauuuuugcucugcagacgacucgcccga

SEQ ID NO: 10855 - RNA, 51 nt, Artificial Sequence
  Description of Artificial Sequence: Synthetic oligonucleotide
gggaggacgaugcgguuucuuuucacucuuauccgcagacgacucgcccga

SEQ ID NO: 10856 - RNA, 52 nt, Artificial Sequence
  Description of Artificial Sequence: Synthetic oligonucleotide
gggaggacgaugcgguccugucgucuguuucguccccagacgacucgcccga

SEQ ID NO: 10857 - RNA, 51 nt, Artificial Sequence
  Description of Artificial Sequence: Synthetic oligonucleotide
gggaggacgaugcggauguuuucucuucuuuaccgcagacgacucgcccga

SEQ ID NO: 10858 - RNA, 51 nt, Artificial Sequence
  Description of Artificial Sequence: Synthetic oligonucleotide
gggaggacgaugcgguaugaaggggaggugguccgcagacgacucgcccga

SEQ ID NO: 10859 - RNA, 51 nt, Artificial Sequence
  Description of Artificial Sequence: Synthetic oligonucleotide
gggaggacgaugcgggguagguguagggagguccccagacgacucgcccga

SEQ ID NO: 10860 - RNA, 51 nt, Artificial Sequence
  Description of Artificial Sequence: Synthetic oligonucleotide
gggaggacgaugcgguuuuauucacuuuuuguccccagacgacucgcccga

SEQ ID NO: 10861 - RNA, 51 nt, Artificial Sequence
  Description of Artificial Sequence: Synthetic oligonucleotide
gggaggacgaugcggcaucauguuuugcuuucguccagacgacucgcccga

SEQ ID NO: 10862 - RNA, 52 nt, Artificial Sequence
  Description of Artificial Sequence: Synthetic oligonucleotide
gggaggacgaugcggcuuuucucuucuuguuuaccgcagacgacucgcccga

SEQ ID NO: 10863 - RNA, 51 nt, Artificial Sequence
  Description of Artificial Sequence: Synthetic oligonucleotide
gggaggacgaugcgguauuuacuucuuuuugcccgcagacgacucgcccga

SEQ ID NO: 10864 - RNA, 51 nt, Artificial Sequence
  Description of Artificial Sequence: Synthetic oligonucleotide
gggaggacgaugcgguuuuuguuccauuuuauccgcagacgacucgcccga

SEQ ID NO: 10865 - RNA, 51 nt, Artificial Sequence
  Description of Artificial Sequence: Synthetic oligonucleotide
gggaggacgaugcggcuuuucuucuuuucuuuccgcagacgacucgcccga

SEQ ID NO: 10866 - RNA, 51 nt, Artificial Sequence
  Description of Artificial Sequence: Synthetic oligonucleotide
gggaggacgaugcggauuuuuuccuguuuuugccgcagacgacucgcccga

SEQ ID NO: 10867 - RNA, 51 nt, Artificial Sequence
  Description of Artificial Sequence: Synthetic oligonucleotide
gggaggacgaugcggcuuuuuauuacuuuucuccgcagacgacucgcccga

SEQ ID NO: 10868 - RNA, 51 nt, Artificial Sequence
  Description of Artificial Sequence: Synthetic oligonucleotide
gggaggacgaugcgguuuuucuuauguuugcuccgcagacgacucgcccga

SEQ ID NO: 10869 - RNA, 51 nt, Artificial Sequence
  Description of Artificial Sequence: Synthetic oligonucleotide
gggaggacgaugcggccuuuuucuuuccuuuuccgcagacgacucgcccga

SEQ ID NO: 10870 - RNA, 51 nt, Artificial Sequence
  Description of Artificial Sequence: Synthetic oligonucleotide
gggaggacgaugcgguuuauauuuuguuuccugugcagacgacucgcccga

SEQ ID NO: 10871 - RNA, 51 nt, Artificial Sequence
  Description of Artificial Sequence: Synthetic oligonucleotide
gggaggacgaugcggcuucuuuucucgcuuuuccgcagacgacucgcccga

SEQ ID NO: 10872 - RNA, 51 nt, Artificial Sequence
  Description of Artificial Sequence: Synthetic oligonucleotide
gggaggacgaugcggauuucucuucuauuuuaccgcagacgacucgcccga

SEQ ID NO: 10873 - RNA, 51 nt, Artificial Sequence
  Description of Artificial Sequence: Synthetic oligonucleotide
gggaggacgaugcgguucuuucuuucccuuuuccgcagacgacucgcccga

SEQ ID NO: 10874 - RNA, 51 nt, Artificial Sequence
  Description of Artificial Sequence: Synthetic oligonucleotide
gggaggacgaugcgguuuucuugcccuuuuuuccgcagacgacucgcccga

SEQ ID NO: 10875 - RNA, 51 nt, Artificial Sequence
  Description of Artificial Sequence: Synthetic oligonucleotide
gggaggacgaugcgguuuuucugucuuuugcuccgcagacgacucgcccga

SEQ ID NO: 10876 - RNA, 51 nt, Artificial Sequence
  Description of Artificial Sequence: Synthetic oligonucleotide
gggaggacgaugcgggauggugguguaggguacugcagacgacucgcccga

SEQ ID NO: 10877 - RNA, 53 nt, Artificial Sequence
  Description of Artificial Sequence: Synthetic oligonucleotide
gggaggacgaugcgguuuuagcuucuuuuuuuguccgcagacgacucgcccga

SEQ ID NO: 10878 - RNA, 51 nt, Artificial Sequence
  Description of Artificial Sequence: Synthetic oligonucleotide
gggaggacgaugcgguuuucacuauucucucuccgcagacgacucgcccga

SEQ ID NO: 10879 - RNA, 51 nt, Artificial Sequence
  Description of Artificial Sequence: Synthetic oligonucleotide
gggaggacgaugcggccacuuauuuccuuuuuccgcagacgacucgcccga

SEQ ID NO: 10880 - RNA, 51 nt, Artificial Sequence
  Description of Artificial Sequence: Synthetic oligonucleotide
gggaggacgaugcgguucuuucuucuuuuccuccgcagacgacucgcccga

SEQ ID NO: 10881 - RNA, 51 nt, Artificial Sequence
  Description of Artificial Sequence: Synthetic oligonucleotide
gggaggacgaugcgguuuuaucuuacuuuuugcugcagacgacucgcccga

SEQ ID NO: 10882 - RNA, 51 nt, Artificial Sequence
  Description of Artificial Sequence: Synthetic oligonucleotide
gggaggacgaugcggaacuacuuuuucucucuccgcagacgacucgcccga

SEQ ID NO: 10883 - RNA, 51 nt, Artificial Sequence
  Description of Artificial Sequence: Synthetic oligonucleotide
gggaggacgaugcgguucuuuucuuauucuuuccgcagacgacucgcccga

SEQ ID NO: 10884 - RNA, 52 nt, Artificial Sequence
  Description of Artificial Sequence: Synthetic oligonucleotide
gggaggacgaugcgguccugucgucuguucgucccccagacgacucgcccga

SEQ ID NO: 10885 - RNA, 51 nt, Artificial Sequence
  Description of Artificial Sequence: Synthetic oligonucleotide
gggaggacgaugcggcuuuucauuucucuuuaccgcagacgacucgcccga

SEQ ID NO: 10886 - RNA, 52 nt, Artificial Sequence
  Description of Artificial Sequence: Synthetic oligonucleotide
gggaggacgaugcgguuuauuuucuucucauuuccgcagacgacucgcccga

SEQ ID NO: 10887 - RNA, 51 nt, Artificial Sequence
  Description of Artificial Sequence: Synthetic oligonucleotide
gggaggacgaugcggauucuguuuucuuguuaccgcagacgacucgcccga

SEQ ID NO: 10888 - RNA, 49 nt, Artificial Sequence
  Description of Artificial Sequence: Synthetic oligonucleotide
gggaggacgaugcgguuucuuguuucuuuuccgcagacgacucgcccga

SEQ ID NO: 10889 - RNA, 51 nt, Artificial Sequence
  Description of Artificial Sequence: Synthetic oligonucleotide
gggaggacgaugcgguuuuuccuuuugccguuccgcagacgacucgcccga

SEQ ID NO: 10890 - RNA, 51 nt, Artificial Sequence
  Description of Artificial Sequence: Synthetic oligonucleotide
gggaggacgaugcgguucuuuauccuuuuucuccgcagacgacucgcccga

SEQ ID NO: 10891 - RNA, 51 nt, Artificial Sequence
  Description of Artificial Sequence: Synthetic oligonucleotide
gggaggacgaugcgguccugucgucuguucguccucagacgacucgcccga

SEQ ID NO: 10892 - RNA, 51 nt, Artificial Sequence
  Description of Artificial Sequence: Synthetic oligonucleotide
gggaggacgaugcgguuuauucuuuucuuugcccccagacgacucgcccga

SEQ ID NO: 10893 - RNA, 51 nt, Artificial Sequence
  Description of Artificial Sequence: Synthetic oligonucleotide
gggaggacgaugcgguccugucgacuguucguccccagacgacucgcccga

SEQ ID NO: 10894 - RNA, 51 nt, Artificial Sequence
  Description of Artificial Sequence: Synthetic oligonucleotide
gggaggacgaugcggcucauuucuucucuuuuccgcagacgacucgcccga

SEQ ID NO: 10895 - RNA, 51 nt, Artificial Sequence
  Description of Artificial Sequence: Synthetic oligonucleotide
gggaggacgaugcggcuuuuacuguucuuuuaccgcagacgacucgcccga

SEQ ID NO: 10896 - RNA, 51 nt, Artificial Sequence
  Description of Artificial Sequence: Synthetic oligonucleotide
gggaggacgaugcgguuuuugucuuguuuuuuccgcagacgacucgcccga

SEQ ID NO: 10897 - RNA, 51 nt, Artificial Sequence
  Description of Artificial Sequence: Synthetic oligonucleotide
gggaggacgaugcgguuuucuauuauucuuuuccgcagacgacucgcccga

SEQ ID NO: 10898 - RNA, 51 nt, Artificial Sequence
  Description of Artificial Sequence: Synthetic oligonucleotide
gggaggacgaugcggucuuucacuuacuuuuuccgcagacgacucgcccga

SEQ ID NO: 10899 - RNA, 51 nt, Artificial Sequence
  Description of Artificial Sequence: Synthetic oligonucleotide
gggaggacgaugcgguuuucuaggcuuuuuuuccgcagacgacucgcccga

SEQ ID NO: 10900 - RNA, 51 nt, Artificial Sequence
  Description of Artificial Sequence: Synthetic oligonucleotide
gggaggacgaugcgguuccacuucuuuucuuuccgcagacgacucgcccga

SEQ ID NO: 10901 - RNA, 51 nt, Artificial Sequence
  Description of Artificial Sequence: Synthetic oligonucleotide
gggaggacgaugcgguuuuuguuuuguuuuuggugcagacgacucgcccga

SEQ ID NO: 10902 - RNA, 51 nt, Artificial Sequence
  Description of Artificial Sequence: Synthetic oligonucleotide
gggaggacgaugcggauuuuacucucauuuuaccgcagacgacucgcccga

SEQ ID NO: 10903 - RNA, 50 nt, Artificial Sequence
  Description of Artificial Sequence: Synthetic oligonucleotide
gggaggacgaugcggucuuuugcuuucuuuuccgcagacgacucgcccga

SEQ ID NO: 10904 - RNA, 51 nt, Artificial Sequence
  Description of Artificial Sequence: Synthetic oligonucleotide
gggaggacgaugcgguuuucauuuacuucgcuccgcagacgacucgcccga

SEQ ID NO: 10905 - RNA, 51 nt, Artificial Sequence
  Description of Artificial Sequence: Synthetic oligonucleotide
gggaggacgaugcggccuuuaauuauuucucuccgcagacgacucgcccga

SEQ ID NO: 10906 - RNA, 51 nt, Artificial Sequence
  Description of Artificial Sequence: Synthetic oligonucleotide
gggaggacgaugcgguuuacucuuuucacuuuccccagacgacucgcccga

SEQ ID NO: 10907 - RNA, 51 nt, Artificial Sequence
  Description of Artificial Sequence: Synthetic oligonucleotide
gggaggacgaugcggauuuucccuuucuuuugccgcagacgacucgcccga

SEQ ID NO: 10908 - RNA, 51 nt, Artificial Sequence
  Description of Artificial Sequence: Synthetic oligonucleotide
gggaggacgaugcgguucuuuucuuucuuucuccgcagacgacucgcccga

SEQ ID NO: 10909 - RNA, 51 nt, Artificial Sequence
  Description of Artificial Sequence: Synthetic oligonucleotide
gggaggacgaugcggagaggcguagggagguuccgcagacgacucgcccga

SEQ ID NO: 10910 - RNA, 51 nt, Artificial Sequence
  Description of Artificial Sequence: Synthetic oligonucleotide
gggaggacgaugcggaccuuuucucucucuauccgcagacgacucgcccga

SEQ ID NO: 10911 - RNA, 52 nt, Artificial Sequence
  Description of Artificial Sequence: Synthetic oligonucleotide
gggaggacgaugcggucuuuuuuuguuuuucugccgcagacgacucgcccga

SEQ ID NO: 10912 - RNA, 51 nt, Artificial Sequence
  Description of Artificial Sequence: Synthetic oligonucleotide
gggaggacgaugcggcuuuucacucgcuuuuuccgcagacgacucgcccga

SEQ ID NO: 10913 - RNA, 51 nt, Artificial Sequence
  Description of Artificial Sequence: Synthetic oligonucleotide
gggaggacgaugcgguuauuuuauuuccuuugccccagacgacucgcccga

SEQ ID NO: 10914 - RNA, 51 nt, Artificial Sequence
  Description of Artificial Sequence: Synthetic oligonucleotide
gggaggacgaugcgguccugucgucugugcguccccagacgacucgcccga

SEQ ID NO: 10915 - RNA, 51 nt, Artificial Sequence
  Description of Artificial Sequence: Synthetic oligonucleotide
gggaggacgaugcggauuuuuguauucuuuugccccagacgacucgcccga

SEQ ID NO: 10916 - RNA, 51 nt, Artificial Sequence
  Description of Artificial Sequence: Synthetic oligonucleotide
gggaggacgaugcggaucuauuuauuuucucaccgcagacgacucgcccga

SEQ ID NO: 10917 - RNA, 51 nt, Artificial Sequence
  Description of Artificial Sequence: Synthetic oligonucleotide
gggaggacgaugcgguuuucuuuccuuauuugccgcagacgacucgcccga

SEQ ID NO: 10918 - RNA, 51 nt, Artificial Sequence
  Description of Artificial Sequence: Synthetic oligonucleotide
gggaggacgaugcgguuuuucucaagcuuuuuccgcagacgacucgcccga

SEQ ID NO: 10919 - RNA, 51 nt, Artificial Sequence
  Description of Artificial Sequence: Synthetic oligonucleotide
gggaggacgaugcggcuucuuuuucuuucuuuccgcagacgacucgcccga

SEQ ID NO: 10920 - RNA, 51 nt, Artificial Sequence
  Description of Artificial Sequence: Synthetic oligonucleotide
gggaggacgaugcggcuuuaccuuuuucuuuuccgcagacgacucgcccga

SEQ ID NO: 10921 - RNA, 51 nt, Artificial Sequence
  Description of Artificial Sequence: Synthetic oligonucleotide
gggaggacgaugcgguacuuuucuuuuuuucuccgcagacgacucgcccga

SEQ ID NO: 10922 - RNA, 51 nt, Artificial Sequence
  Description of Artificial Sequence: Synthetic oligonucleotide
gggaggacgaugcgguuucuuauuuccguuuuccgcagacgacucgcccga

SEQ ID NO: 10923 - RNA, 51 nt, Artificial Sequence
  Description of Artificial Sequence: Synthetic oligonucleotide
gggaggacgaugcggcucuuucuucuuuuucuccgcagacgacucgcccga

SEQ ID NO: 10924 - RNA, 51 nt, Artificial Sequence
  Description of Artificial Sequence: Synthetic oligonucleotide
gggaggacgaugcggccuuuuuauuccuuuugccgcagacgacucgcccga

SEQ ID NO: 10925 - RNA, 51 nt, Artificial Sequence
  Description of Artificial Sequence: Synthetic oligonucleotide
gggaggacgaugcggccuuuuauuauucccuuccgcagacgacucgcccga

SEQ ID NO: 10926 - RNA, 50 nt, Artificial Sequence
  Description of Artificial Sequence: Synthetic oligonucleotide
gggaggacgaugcgguuauucucucuuucuuccgcagacgacucgcccga

SEQ ID NO: 10927 - RNA, 51 nt, Artificial Sequence
  Description of Artificial Sequence: Synthetic oligonucleotide
gggaggacgaugcggucuuuuuauuugcuuuuccgcagacgacucgcccga

SEQ ID NO: 10928 - RNA, 51 nt, Artificial Sequence
  Description of Artificial Sequence: Synthetic oligonucleotide
gggaggacgaugcgguuuuacacuuuuccccuccgcagacgacucgcccga

SEQ ID NO: 10929 - RNA, 51 nt, Artificial Sequence
  Description of Artificial Sequence: Synthetic oligonucleotide
gggaggacgaugcggauuuuugucuuuuguuacugcagacgacucgcccga

SEQ ID NO: 10930 - RNA, 51 nt, Artificial Sequence
  Description of Artificial Sequence: Synthetic oligonucleotide
gggaggacgaugcgguuuuguuucacuuuugucugcagacgacucgcccga

SEQ ID NO: 10931 - RNA, 51 nt, Artificial Sequence
  Description of Artificial Sequence: Synthetic oligonucleotide
gggaggacgaugcggucucuuuuuccuuaucuccgcagacgacucgcccga

SEQ ID NO: 10932 - RNA, 51 nt, Artificial Sequence
  Description of Artificial Sequence: Synthetic oligonucleotide
gggaggacgaugcggauauuuuguuuuucuugccccagacgacucgcccga

SEQ ID NO: 10933 - RNA, 51 nt, Artificial Sequence
  Description of Artificial Sequence: Synthetic oligonucleotide
gggaggacgaugcggauuauuuacucuuucuaccgcagacgacucgcccga

SEQ ID NO: 10934 - RNA, 51 nt, Artificial Sequence
  Description of Artificial Sequence: Synthetic oligonucleotide
gggaggacgaugcggaucuuuaauuucucuugccgcagacgacucgcccga

SEQ ID NO: 10935 - RNA, 51 nt, Artificial Sequence
  Description of Artificial Sequence: Synthetic oligonucleotide
gggaggacgaugcggcuuuuauucuugcucuaccgcagacgacucgcccga

SEQ ID NO: 10936 - RNA, 51 nt, Artificial Sequence
  Description of Artificial Sequence: Synthetic oligonucleotide
gggaggacgaugcggcuuuuuucucucuuuuaccgcagacgacucgcccga

SEQ ID NO: 10937 - RNA, 51 nt, Artificial Sequence
  Description of Artificial Sequence: Synthetic oligonucleotide
gggaggacgaugcggcuuuuccuuuuuuuguuccgcagacgacucgcccga

SEQ ID NO: 10938 - RNA, 52 nt, Artificial Sequence
  Description of Artificial Sequence: Synthetic oligonucleotide
gggaggacgaugcgguuuuucacuuuuuucgccccgcagacgacucgcccga

SEQ ID NO: 10939 - RNA, 51 nt, Artificial Sequence
  Description of Artificial Sequence: Synthetic oligonucleotide
gggaggacgaugcgguuuuucuacucuuuuuuccgcagacgacucgcccga

SEQ ID NO: 10940 - RNA, 51 nt, Artificial Sequence
  Description of Artificial Sequence: Synthetic oligonucleotide
gggaggacgaugcgguccuguccucuguucguccccagacgacucgcccga

SEQ ID NO: 10941 - RNA, 51 nt, Artificial Sequence
  Description of Artificial Sequence: Synthetic oligonucleotide
gggaggacgaugcgguccugucguauguucguccccagacgacucgcccga

SEQ ID NO: 10942 - RNA, 51 nt, Artificial Sequence
  Description of Artificial Sequence: Synthetic oligonucleotide
gggaggacgaugcggacuuuucuuuccauucaccgcagacgacucgcccga

SEQ ID NO: 10943 - RNA, 51 nt, Artificial Sequence
  Description of Artificial Sequence: Synthetic oligonucleotide
gggaggacgaugcggguuguuucacucuuuuuccgcagacgacucgcccga

SEQ ID NO: 10944 - RNA, 51 nt, Artificial Sequence
  Description of Artificial Sequence: Synthetic oligonucleotide
gggaggacgaugcggauuuacauuucuuuuugccccagacgacucgcccga

SEQ ID NO: 10945 - RNA, 51 nt, Artificial Sequence
  Description of Artificial Sequence: Synthetic oligonucleotide
gggaggacgaugcggucuuuuacauucccuuuccgcagacgacucgcccga

SEQ ID NO: 10946 - RNA, 51 nt, Artificial Sequence
  Description of Artificial Sequence: Synthetic oligonucleotide
gggaggacgaugcggaucuuuaucucuuuuccccgcagacgacucgcccga

SEQ ID NO: 10947 - RNA, 51 nt, Artificial Sequence
  Description of Artificial Sequence: Synthetic oligonucleotide
gggaggacgaugcgguucuuuguacuuucccuccgcagacgacucgcccga

SEQ ID NO: 10948 - RNA, 51 nt, Artificial Sequence
  Description of Artificial Sequence: Synthetic oligonucleotide
gggaggacgaugcggguuuauucaucccuuuuccgcagacgacucgcccga

SEQ ID NO: 10949 - RNA, 51 nt, Artificial Sequence
  Description of Artificial Sequence: Synthetic oligonucleotide
gggaggacgaugcggauuuuucgccuauuuuaccgcagacgacucgcccga

SEQ ID NO: 10950 - RNA, 51 nt, Artificial Sequence
  Description of Artificial Sequence: Synthetic oligonucleotide
gggaggacgaugcgggcuuuuccuucuuuuucccgcagacgacucgcccga

SEQ ID NO: 10951 - RNA, 51 nt, Artificial Sequence
  Description of Artificial Sequence: Synthetic oligonucleotide
gggaggacgaugcggauucuugcuuuuuuuugccgcagacgacucgcccga

SEQ ID NO: 10952 - RNA, 51 nt, Artificial Sequence
  Description of Artificial Sequence: Synthetic oligonucleotide
gggaggacgaugcgguuuuugucacguuuucuccgcagacgacucgcccga

SEQ ID NO: 10953 - RNA, 51 nt, Artificial Sequence
  Description of Artificial Sequence: Synthetic oligonucleotide
gggaggacgaugcgguuuuguucuuuuuucuuccgcagacgacucgcccga

SEQ ID NO: 10954 - RNA, 51 nt, Artificial Sequence
  Description of Artificial Sequence: Synthetic oligonucleotide
gggaggacgaugcggcuuuuauucacuuuuuuccgcagacgacucgcccga

SEQ ID NO: 10955 - RNA, 51 nt, Artificial Sequence
  Description of Artificial Sequence: Synthetic oligonucleotide
gggaggacgaugcgguuauuuuuuuguuuguugugcagacgacucgcccga

SEQ ID NO: 10956 - RNA, 51 nt, Artificial Sequence
  Description of Artificial Sequence: Synthetic oligonucleotide
gggaggacgaugcggcuuucuuguuucuucuaccgcagacgacucgcccga

SEQ ID NO: 10957 - RNA, 51 nt, Artificial Sequence
  Description of Artificial Sequence: Synthetic oligonucleotide
gggaggacgaugcgguuuucauuauuuacuuuccgcagacgacucgcccga

SEQ ID NO: 10958 - RNA, 51 nt, Artificial Sequence
  Description of Artificial Sequence: Synthetic oligonucleotide
gggaggacgaugcggauuuuauuucccuuuuaccgcagacgacucgcccga

SEQ ID NO: 10959 - RNA, 51 nt, Artificial Sequence
  Description of Artificial Sequence: Synthetic oligonucleotide
gggaggacgaugcgguuuuuguuaauuugucccugcagacgacucgcccga

SEQ ID NO: 10960 - RNA, 51 nt, Artificial Sequence
  Description of Artificial Sequence: Synthetic oligonucleotide
gggaggacgaugcgguuuuaucuuucuuuuuuccccagacgacucgcccga

SEQ ID NO: 10961 - RNA, 51 nt, Artificial Sequence
  Description of Artificial Sequence: Synthetic oligonucleotide
gggaggacgaugcggguuugcucuuuuuucugccgcagacgacucgcccga

SEQ ID NO: 10962 - RNA, 51 nt, Artificial Sequence
  Description of Artificial Sequence: Synthetic oligonucleotide
gggaggacgaugcggucauuacuucuuuucauccgcagacgacucgcccga

SEQ ID NO: 10963 - RNA, 51 nt, Artificial Sequence
  Description of Artificial Sequence: Synthetic oligonucleotide
gggaggacgaugcgguccggucgucuguucguccccagacgacucgcccga

SEQ ID NO: 10964 - RNA, 51 nt, Artificial Sequence
  Description of Artificial Sequence: Synthetic oligonucleotide
gggaggacgaugcggauuuucauuuuuuuccgccgcagacgacucgcccga

SEQ ID NO: 10965 - RNA, 51 nt, Artificial Sequence
  Description of Artificial Sequence: Synthetic oligonucleotide
gggaggacgaugcggcuuuuuuuauuucccuuccgcagacgacucgcccga

SEQ ID NO: 10966 - RNA, 51 nt, Artificial Sequence
  Description of Artificial Sequence: Synthetic oligonucleotide
gggaggacgaugcggacuucuauccuucuuuuccgcagacgacucgcccga

SEQ ID NO: 10967 - RNA, 51 nt, Artificial Sequence
  Description of Artificial Sequence: Synthetic oligonucleotide
gggaggacgaugcggucuuuucguuuucuucuccgcagacgacucgcccga

SEQ ID NO: 10968 - RNA, 51 nt, Artificial Sequence
  Description of Artificial Sequence: Synthetic oligonucleotide
gggaggacgaugcggccguuuauuuccuuuuuccgcagacgacucgcccga

SEQ ID NO: 10969 - RNA, 52 nt, Artificial Sequence
  Description of Artificial Sequence: Synthetic oligonucleotide
gggaggacgaugcgguauuuauuuuuucuugccccgcagacgacucgcccga

SEQ ID NO: 10970 - RNA, 51 nt, Artificial Sequence
  Description of Artificial Sequence: Synthetic oligonucleotide
gggaggacgaugcgguuuucucacucuuuucuccgcagacgacucgcccga

SEQ ID NO: 10971 - RNA, 51 nt, Artificial Sequence
  Description of Artificial Sequence: Synthetic oligonucleotide
gggaggacgaugcggauuucuuauuccuuuccccgcagacgacucgcccga

SEQ ID NO: 10972 - RNA, 51 nt, Artificial Sequence
  Description of Artificial Sequence: Synthetic oligonucleotide
gggaggacgaugcgguuauuuucacuguuuuugcccagacgacucgcccga

SEQ ID NO: 10973 - RNA, 53 nt, Artificial Sequence
  Description of Artificial Sequence: Synthetic oligonucleotide
gggaggacgaugcgguuuuucacuuuuucuucugcgccagacgacucgcccga

SEQ ID NO: 10974 - RNA, 52 nt, Artificial Sequence
  Description of Artificial Sequence: Synthetic oligonucleotide
gggaggacgaugcgguuuuuuauuuuccugguuccgcagacgacucgcccga

SEQ ID NO: 10975 - RNA, 51 nt, Artificial Sequence
  Description of Artificial Sequence: Synthetic oligonucleotide
gggaggacgaugcggucuauuucuugcuuuuuccgcagacgacucgcccga

SEQ ID NO: 10976 - RNA, 52 nt, Artificial Sequence
  Description of Artificial Sequence: Synthetic oligonucleotide
gggaggacgaugcgguucuuuauuuuuuucccuccgcagacgacucgcccga

SEQ ID NO: 10977 - RNA, 51 nt, Artificial Sequence
  Description of Artificial Sequence: Synthetic oligonucleotide
gggaggacgaugcggucguuuauuucuuuuuuccgcagacgacucgcccga

SEQ ID NO: 10978 - RNA, 50 nt, Artificial Sequence
  Description of Artificial Sequence: Synthetic oligonucleotide
gggaggacgaugcgguccugucgucuuacguccccagacgacucgcccga

SEQ ID NO: 10979 - RNA, 51 nt, Artificial Sequence
  Description of Artificial Sequence: Synthetic oligonucleotide
gggaggacgaugcggaucuuucuucucuauuaccgcagacgacucgcccga

SEQ ID NO: 10980 - RNA, 51 nt, Artificial Sequence
  Description of Artificial Sequence: Synthetic oligonucleotide
gggaggacgaugcggauuuguuauguuuuguaccgcagacgacucgcccga

SEQ ID NO: 10981 - RNA, 51 nt, Artificial Sequence
  Description of Artificial Sequence: Synthetic oligonucleotide
gggaggacgaugcgguuuuuguuuuuauuuuuccgcagacgacucgcccga

SEQ ID NO: 10982 - RNA, 51 nt, Artificial Sequence
  Description of Artificial Sequence: Synthetic oligonucleotide
gggaggacgaugcgguuuuuuccucgcuuuugccgcagacgacucgcccga

SEQ ID NO: 10983 - RNA, 51 nt, Artificial Sequence
  Description of Artificial Sequence: Synthetic oligonucleotide
gggaggacgaugcgguucgcuuucucuuuuauccgcagacgacucgcccga

SEQ ID NO: 10984 - RNA, 51 nt, Artificial Sequence
  Description of Artificial Sequence: Synthetic oligonucleotide
gggaggacgaugcgguuucuugauccuuuuuuccgcagacgacucgcccga

SEQ ID NO: 10985 - RNA, 51 nt, Artificial Sequence
  Description of Artificial Sequence: Synthetic oligonucleotide
gggaggacgaugcggauuuucucacucucuuaccgcagacgacucgcccga

SEQ ID NO: 10986 - RNA, 50 nt, Artificial Sequence
  Description of Artificial Sequence: Synthetic oligonucleotide
gggaggacgaugcgguuuuucuuauucuuuuccgcagacgacucgcccga

SEQ ID NO: 10987 - RNA, 50 nt, Artificial Sequence
  Description of Artificial Sequence: Synthetic oligonucleotide
gggaggacgaugcgguccugucgucuguuccccccagacgacucgcccga

SEQ ID NO: 10988 - RNA, 51 nt, Artificial Sequence
  Description of Artificial Sequence: Synthetic oligonucleotide
gggaggacgaugcggauuuaucuucuuuuuccccgcagacgacucgcccga

SEQ ID NO: 10989 - RNA, 51 nt, Artificial Sequence
  Description of Artificial Sequence: Synthetic oligonucleotide
gggaggacgaugcggcuuuuucuucauuuuuuccgcagacgacucgcccga

SEQ ID NO: 10990 - RNA, 51 nt, Artificial Sequence
  Description of Artificial Sequence: Synthetic oligonucleotide
gggaggacgaugcggcuuacuuuuuacuuccuccgcagacgacucgcccga

SEQ ID NO: 10991 - RNA, 51 nt, Artificial Sequence
  Description of Artificial Sequence: Synthetic oligonucleotide
gggaggacgaugcgguuuucaauuauuucuguccgcagacgacucgcccga

SEQ ID NO: 10992 - RNA, 51 nt, Artificial Sequence
  Description of Artificial Sequence: Synthetic oligonucleotide
gggaggacgaugcgguuucucuucuuuucuauccgcagacgacucgcccga

SEQ ID NO: 10993 - RNA, 51 nt, Artificial Sequence
  Description of Artificial Sequence: Synthetic oligonucleotide
gggaggacgaugcggaucuuuucgcuuuuuuaccgcagacgacucgcccga

SEQ ID NO: 10994 - RNA, 51 nt, Artificial Sequence
  Description of Artificial Sequence: Synthetic oligonucleotide
gggaggacgaugcgguccugucgucgguucguccccagacgacucgcccga

SEQ ID NO: 10995 - RNA, 51 nt, Artificial Sequence
  Description of Artificial Sequence: Synthetic oligonucleotide
gggaggacgaugcggucucaucuucuuuuucuccgcagacgacucgcccga

SEQ ID NO: 10996 - RNA, 51 nt, Artificial Sequence
  Description of Artificial Sequence: Synthetic oligonucleotide
gggaggacgaugcgguucuugcuuuauuuuuuccgcagacgacucgcccga

SEQ ID NO: 10997 - RNA, 51 nt, Artificial Sequence
  Description of Artificial Sequence: Synthetic oligonucleotide
gggaggacgaugcggauuuuauuguuuuuuuaccgcagacgacucgcccga

SEQ ID NO: 10998 - RNA, 52 nt, Artificial Sequence
  Description of Artificial Sequence: Synthetic oligonucleotide
gggaggacgaugcgguuuuuacccuuuuuuuguccgcagacgacucgcccga

SEQ ID NO: 10999 - RNA, 51 nt, Artificial Sequence
  Description of Artificial Sequence: Synthetic oligonucleotide
gggaggacgaugcgguuuuuucagauuuguuuccgcagacgacucgcccga

SEQ ID NO: 11000 - RNA, 52 nt, Artificial Sequence
  Description of Artificial Sequence: Synthetic oligonucleotide
gggaggacgaugcggucucuucuuucuuuaucgccgcagacgacucgcccga

SEQ ID NO: 11001 - RNA, 51 nt, Artificial Sequence
  Description of Artificial Sequence: Synthetic oligonucleotide
gggaggacgaugcggcuuuucuuuuucccuauccgcagacgacucgcccga

SEQ ID NO: 11002 - RNA, 51 nt, Artificial Sequence
  Description of Artificial Sequence: Synthetic oligonucleotide
gggaggacgaugcggccauucacuuuucuuuuccgcagacgacucgcccga

SEQ ID NO: 11003 - RNA, 51 nt, Artificial Sequence
  Description of Artificial Sequence: Synthetic oligonucleotide
gggaggacgaugcgguuuucucuuuuccauuuccgcagacgacucgcccga

SEQ ID NO: 11004 - RNA, 51 nt, Artificial Sequence
  Description of Artificial Sequence: Synthetic oligonucleotide
gggaggacgaugcggcuuuucucuuuuuuccgcgccagacgacucgcccga

SEQ ID NO: 11005 - RNA, 51 nt, Artificial Sequence
  Description of Artificial Sequence: Synthetic oligonucleotide
gggaggacgaugcgguuuguauuccccuuuuuccgcagacgacucgcccga

SEQ ID NO: 11006 - RNA, 51 nt, Artificial Sequence
  Description of Artificial Sequence: Synthetic oligonucleotide
gggaggacgaugcggucucuuuauuuuuucuuccgcagacgacucgcccga

SEQ ID NO: 11007 - RNA, 52 nt, Artificial Sequence
  Description of Artificial Sequence: Synthetic oligonucleotide
gggaggacgaugcggauucucuuuuuuuucccaccgcagacgacucgcccga

SEQ ID NO: 11008 - RNA, 51 nt, Artificial Sequence
  Description of Artificial Sequence: Synthetic oligonucleotide
gggaggacgaugcggcuuucuacucucuucuuccgcagacgacucgcccga

SEQ ID NO: 11009 - RNA, 51 nt, Artificial Sequence
  Description of Artificial Sequence: Synthetic oligonucleotide
gggaggacgaugcggguugggaguaggguguuccgcagacgacucgcccga

SEQ ID NO: 11010 - RNA, 51 nt, Artificial Sequence
  Description of Artificial Sequence: Synthetic oligonucleotide
gggaggacgaugcgguuuuauuauuaccuguuccgcagacgacucgcccga

SEQ ID NO: 11011 - RNA, 51 nt, Artificial Sequence
  Description of Artificial Sequence: Synthetic oligonucleotide
gggaggacgaugcggauuuucucauccuuuugccgcagacgacucgcccga

SEQ ID NO: 11012 - RNA, 51 nt, Artificial Sequence
  Description of Artificial Sequence: Synthetic oligonucleotide
gggaggacgaugcgguacauucuuuuuucucuccgcagacgacucgcccga

SEQ ID NO: 11013 - RNA, 50 nt, Artificial Sequence
  Description of Artificial Sequence: Synthetic oligonucleotide
gggaggacgaugcgguuugggaguaggguguccgcagacgacucgcccga

SEQ ID NO: 11014 - RNA, 51 nt, Artificial Sequence
  Description of Artificial Sequence: Synthetic oligonucleotide
gggaggacgaugcgguucauuuacauucuuuuccgcagacgacucgcccga

SEQ ID NO: 11015 - RNA, 51 nt, Artificial Sequence
  Description of Artificial Sequence: Synthetic oligonucleotide
gggaggacgaugcggacuuucacuauuuuuuaccgcagacgacucgcccga

SEQ ID NO: 11016 - RNA, 51 nt, Artificial Sequence
  Description of Artificial Sequence: Synthetic oligonucleotide
gggaggacgaugcggaucaugucuucuuuucuccgcagacgacucgcccga

SEQ ID NO: 11017 - RNA, 52 nt, Artificial Sequence
  Description of Artificial Sequence: Synthetic oligonucleotide
gggaggacgaugcggaacuacuuuuuucucucuccgcagacgacucgcccga

SEQ ID NO: 11018 - RNA, 51 nt, Artificial Sequence
  Description of Artificial Sequence: Synthetic oligonucleotide
gggaggacgaugcgguuuccuuuuuuucccauccgcagacgacucgcccga

SEQ ID NO: 11019 - RNA, 51 nt, Artificial Sequence
  Description of Artificial Sequence: Synthetic oligonucleotide
gggaggacgaugcgguuucuuacucuucauuuccgcagacgacucgcccga

SEQ ID NO: 11020 - RNA, 51 nt, Artificial Sequence
  Description of Artificial Sequence: Synthetic oligonucleotide
gggaggacgaugcggucuucauucuauuuucuccgcagacgacucgcccga

SEQ ID NO: 11021 - RNA, 51 nt, Artificial Sequence
  Description of Artificial Sequence: Synthetic oligonucleotide
gggaggacgaugcgguuuucuuaaucccuuuuccgcagacgacucgcccga

SEQ ID NO: 11022 - RNA, 51 nt, Artificial Sequence
  Description of Artificial Sequence: Synthetic oligonucleotide
gggaggacgaugcggauuguuuuauuguuuuaccgcagacgacucgcccga

SEQ ID NO: 11023 - RNA, 51 nt, Artificial Sequence
  Description of Artificial Sequence: Synthetic oligonucleotide
gggaggacgaugcgggauuucuauuuucuccaccccagacgacucgcccga

SEQ ID NO: 11024 - RNA, 51 nt, Artificial Sequence
  Description of Artificial Sequence: Synthetic oligonucleotide
gggaggacgaugcggauuuuuguucuugucuaccgcagacgacucgcccga

SEQ ID NO: 11025 - RNA, 51 nt, Artificial Sequence
  Description of Artificial Sequence: Synthetic oligonucleotide
gggaggacgaugcggcuuuuauuuuaccuucuccgcagacgacucgcccga

SEQ ID NO: 11026 - RNA, 51 nt, Artificial Sequence
  Description of Artificial Sequence: Synthetic oligonucleotide
gggaggacgaugcgguuuuucauuuuaccguuccgcagacgacucgcccga

SEQ ID NO: 11027 - RNA, 51 nt, Artificial Sequence
  Description of Artificial Sequence: Synthetic oligonucleotide
gggaggacgaugcgguuuuucucuuuuuuccgccgcagacgacucgcccga

SEQ ID NO: 11028 - RNA, 51 nt, Artificial Sequence
  Description of Artificial Sequence: Synthetic oligonucleotide
gggaggacgaugcggucucuuacaauuuucuuccgcagacgacucgcccga

SEQ ID NO: 11029 - RNA, 51 nt, Artificial Sequence
  Description of Artificial Sequence: Synthetic oligonucleotide
gggaggacgaugcgguguuucucuuacuuuuuccgcagacgacucgcccga

SEQ ID NO: 11030 - RNA, 51 nt, Artificial Sequence
  Description of Artificial Sequence: Synthetic oligonucleotide
gggaggacgaugcggucuuuuaucaauucucuccgcagacgacucgcccga

SEQ ID NO: 11031 - RNA, 52 nt, Artificial Sequence
  Description of Artificial Sequence: Synthetic oligonucleotide
gggaggacgaugcggaauuauguguuuuugugaccgcagacgacucgcccga

SEQ ID NO: 11032 - RNA, 51 nt, Artificial Sequence
  Description of Artificial Sequence: Synthetic oligonucleotide
gggaggacgaugcggucggugguguggggauuccgcagacgacucgcccga

SEQ ID NO: 11033 - RNA, 51 nt, Artificial Sequence
  Description of Artificial Sequence: Synthetic oligonucleotide
gggaggacgaugcggaccugucgucuguucguccccagacgacucgcccga

SEQ ID NO: 11034 - RNA, 51 nt, Artificial Sequence
  Description of Artificial Sequence: Synthetic oligonucleotide
gggaggacgaugcggacuuuauucucuuuuuuccgcagacgacucgcccga

SEQ ID NO: 11035 - RNA, 51 nt, Artificial Sequence
  Description of Artificial Sequence: Synthetic oligonucleotide
gggaggacgaugcgguuauuuguuuauuuucuccgcagacgacucgcccga

SEQ ID NO: 11036 - RNA, 51 nt, Artificial Sequence
  Description of Artificial Sequence: Synthetic oligonucleotide
gggaggacgaugcgguuuauuuauuuuuccguccccagacgacucgcccga

SEQ ID NO: 11037 - RNA, 51 nt, Artificial Sequence
  Description of Artificial Sequence: Synthetic oligonucleotide
gggaggacgaugcgguucuuuuuacuuuccuuccgcagacgacucgcccga

SEQ ID NO: 11038 - RNA, 51 nt, Artificial Sequence
  Description of Artificial Sequence: Synthetic oligonucleotide
gggaggacgaugcgguauuuuuccuuuuccaugugcagacgacucgcccga

SEQ ID NO: 11039 - RNA, 51 nt, Artificial Sequence
  Description of Artificial Sequence: Synthetic oligonucleotide
gggaggacgaugcggcuuuucuuuguugcuuuccgcagacgacucgcccga

SEQ ID NO: 11040 - RNA, 51 nt, Artificial Sequence
  Description of Artificial Sequence: Synthetic oligonucleotide
gggaggacgaugcggaguuguuuuccuuuuguccgcagacgacucgcccga

SEQ ID NO: 11041 - RNA, 51 nt, Artificial Sequence
  Description of Artificial Sequence: Synthetic oligonucleotide
gggaggacgaugcggaauuugcuucuuuuuauccgcagacgacucgcccga

SEQ ID NO: 11042 - RNA, 51 nt, Artificial Sequence
  Description of Artificial Sequence: Synthetic oligonucleotide
gggaggacgaugcggcuuucacuuacuuucuaccgcagacgacucgcccga

SEQ ID NO: 11043 - RNA, 51 nt, Artificial Sequence
  Description of Artificial Sequence: Synthetic oligonucleotide
gggaggacgaugcggguucuuuauucuucucaccgcagacgacucgcccga

SEQ ID NO: 11044 - RNA, 51 nt, Artificial Sequence
  Description of Artificial Sequence: Synthetic oligonucleotide
gggaggacgaugcggauuuuuuacuucuuucaccgcagacgacucgcccga

SEQ ID NO: 11045 - RNA, 51 nt, Artificial Sequence
  Description of Artificial Sequence: Synthetic oligonucleotide
gggaggacgaugcgguccuguggucuguucguccccagacgacucgcccga

SEQ ID NO: 11046 - RNA, 51 nt, Artificial Sequence
  Description of Artificial Sequence: Synthetic oligonucleotide
gggaggacgaugcgguuucucuacacuuuuugccgcagacgacucgcccga

SEQ ID NO: 11047 - RNA, 51 nt, Artificial Sequence
  Description of Artificial Sequence: Synthetic oligonucleotide
gggaggacgaugcggcuuacucauuucucucuccgcagacgacucgcccga

SEQ ID NO: 11048 - RNA, 51 nt, Artificial Sequence
  Description of Artificial Sequence: Synthetic oligonucleotide
gggaggacgaugcggauuuccuauccuuuuuaccgcagacgacucgcccga

SEQ ID NO: 11049 - RNA, 51 nt, Artificial Sequence
  Description of Artificial Sequence: Synthetic oligonucleotide
gggaggacgaugcggcucuuuacuuuucuccuccgcagacgacucgcccga

SEQ ID NO: 11050 - RNA, 51 nt, Artificial Sequence
  Description of Artificial Sequence: Synthetic oligonucleotide
gggaggacgaugcggauuuucuauuuauuccaccgcagacgacucgcccga

SEQ ID NO: 11051 - RNA, 51 nt, Artificial Sequence
  Description of Artificial Sequence: Synthetic oligonucleotide
gggaggacgaugcgguuguuauucuuuuuuugccccagacgacucgcccga

SEQ ID NO: 11052 - RNA, 51 nt, Artificial Sequence
  Description of Artificial Sequence: Synthetic oligonucleotide
gggaggacgaugcggguuuccuuucucuuuucccgcagacgacucgcccga

SEQ ID NO: 11053 - RNA, 51 nt, Artificial Sequence
  Description of Artificial Sequence: Synthetic oligonucleotide
gggaggacgaugcgguuucauuauuacuuucugcccagacgacucgcccga

SEQ ID NO: 11054 - RNA, 51 nt, Artificial Sequence
  Description of Artificial Sequence: Synthetic oligonucleotide
gggaggacgaugcggcuuuuuaccuucuauuuccgcagacgacucgcccga

SEQ ID NO: 11055 - RNA, 51 nt, Artificial Sequence
  Description of Artificial Sequence: Synthetic oligonucleotide
gggaggacgaugcgguccucucgucuguucguccccagacgacucgcccga

SEQ ID NO: 11056 - RNA, 51 nt, Artificial Sequence
  Description of Artificial Sequence: Synthetic oligonucleotide
gggaggacgaugcggcuuuuaccuuucuuuauccgcagacgacucgcccga

SEQ ID NO: 11057 - RNA, 51 nt, Artificial Sequence
  Description of Artificial Sequence: Synthetic oligonucleotide
gggaggacgaugcgguuuuccuuauucuuuuuccgcagacgacucgcccga

SEQ ID NO: 11058 - RNA, 51 nt, Artificial Sequence
  Description of Artificial Sequence: Synthetic oligonucleotide
gggaggacgaugcgguuauuuuucuucgcuguccgcagacgacucgcccga

SEQ ID NO: 11059 - RNA, 51 nt, Artificial Sequence
  Description of Artificial Sequence: Synthetic oligonucleotide
gggaggacgaugcggucuuuuuuucacuuucuccgcagacgacucgcccga

SEQ ID NO: 11060 - RNA, 51 nt, Artificial Sequence
  Description of Artificial Sequence: Synthetic oligonucleotide
gggaggacgaugcggguuuuacauuucuuuccccccagacgacucgcccga

SEQ ID NO: 11061 - RNA, 51 nt, Artificial Sequence
  Description of Artificial Sequence: Synthetic oligonucleotide
gggaggacgaugcgguuucugacacuuuuuuuccgcagacgacucgcccga

SEQ ID NO: 11062 - RNA, 51 nt, Artificial Sequence
  Description of Artificial Sequence: Synthetic oligonucleotide
gggaggacgaugcgguuucuuuuucuucuucucugcagacgacucgcccga

SEQ ID NO: 11063 - RNA, 52 nt, Artificial Sequence
  Description of Artificial Sequence: Synthetic oligonucleotide
gggaggacgaugcgguuugggaguagggugguaccgcagacgacucgcccga

SEQ ID NO: 11064 - RNA, 51 nt, Artificial Sequence
  Description of Artificial Sequence: Synthetic oligonucleotide
gggaggacgaugcggguuauuucucucuuuguccgcagacgacucgcccga

SEQ ID NO: 11065 - RNA, 51 nt, Artificial Sequence
  Description of Artificial Sequence: Synthetic oligonucleotide
gggaggacgaugcgguuuuucucuuuacguuuccgcagacgacucgcccga

SEQ ID NO: 11066 - RNA, 51 nt, Artificial Sequence
  Description of Artificial Sequence: Synthetic oligonucleotide
gggaggacgaugcgguuuguuguuauuguuguccgcagacgacucgcccga

SEQ ID NO: 11067 - RNA, 51 nt, Artificial Sequence
  Description of Artificial Sequence: Synthetic oligonucleotide
gggaggacgaugcggucuauuuccuuucuuuuccgcagacgacucgcccga

SEQ ID NO: 11068 - RNA, 51 nt, Artificial Sequence
  Description of Artificial Sequence: Synthetic oligonucleotide
gggaggacgaugcgguuuucuuauaucucuguccgcagacgacucgcccga

SEQ ID NO: 11069 - RNA, 51 nt, Artificial Sequence
  Description of Artificial Sequence: Synthetic oligonucleotide
gggaggacgaugcgggauuuugucucuuuuacccgcagacgacucgcccga

SEQ ID NO: 11070 - RNA, 51 nt, Artificial Sequence
  Description of Artificial Sequence: Synthetic oligonucleotide
gggaggacgaugcgguucguuauuuccuuuuuccgcagacgacucgcccga

SEQ ID NO: 11071 - RNA, 51 nt, Artificial Sequence
  Description of Artificial Sequence: Synthetic oligonucleotide
gggaggacgaugcgguuuuuccuaccuuuuuuccgcagacgacucgcccga

SEQ ID NO: 11072 - RNA, 51 nt, Artificial Sequence
  Description of Artificial Sequence: Synthetic oligonucleotide
gggaggacgaugcggcuuuguuuuacuguuuuccgcagacgacucgcccga

SEQ ID NO: 11073 - RNA, 51 nt, Artificial Sequence
  Description of Artificial Sequence: Synthetic oligonucleotide
gggaggacgaugcggucuuuauuuuuuccuuuccgcagacgacucgcccga

SEQ ID NO: 11074 - RNA, 51 nt, Artificial Sequence
  Description of Artificial Sequence: Synthetic oligonucleotide
gggaggacgaugcgguguuuuuguuuauuuugccgcagacgacucgcccga

SEQ ID NO: 11075 - RNA, 51 nt, Artificial Sequence
  Description of Artificial Sequence: Synthetic oligonucleotide
gggaggacgaugcggguuauucuucucuauuuccgcagacgacucgcccga

SEQ ID NO: 11076 - RNA, 51 nt, Artificial Sequence
  Description of Artificial Sequence: Synthetic oligonucleotide
gggaggacgaugcggcuacuucuuauuucuuuccgcagacgacucgcccga

SEQ ID NO: 11077 - RNA, 51 nt, Artificial Sequence
  Description of Artificial Sequence: Synthetic oligonucleotide
gggaggacgaugcgguuuuucauuuccuuuucccgcagacgacucgcccga

SEQ ID NO: 11078 - RNA, 51 nt, Artificial Sequence
  Description of Artificial Sequence: Synthetic oligonucleotide
gggaggacgaugcgguaucuuuugcuuucccuccgcagacgacucgcccga

SEQ ID NO: 11079 - RNA, 51 nt, Artificial Sequence
  Description of Artificial Sequence: Synthetic oligonucleotide
gggaggacgaugcgguuauuaucuuucucgcuccgcagacgacucgcccga

SEQ ID NO: 11080 - RNA, 51 nt, Artificial Sequence
  Description of Artificial Sequence: Synthetic oligonucleotide
gggaggacgaugcgguucuuauuccuucuauuccgcagacgacucgcccga

SEQ ID NO: 11081 - RNA, 51 nt, Artificial Sequence
  Description of Artificial Sequence: Synthetic oligonucleotide
gggaggacgaugcggccuuuuuacucucucuuccgcagacgacucgcccga

SEQ ID NO: 11082 - RNA, 51 nt, Artificial Sequence
  Description of Artificial Sequence: Synthetic oligonucleotide
gggaggacgaugcggucacuuacuuuuuuccucugcagacgacucgcccga

SEQ ID NO: 11083 - RNA, 51 nt, Artificial Sequence
  Description of Artificial Sequence: Synthetic oligonucleotide
gggaggacgaugcgguuacuuauuugcuuuuuccccagacgacucgcccga

SEQ ID NO: 11084 - RNA, 51 nt, Artificial Sequence
  Description of Artificial Sequence: Synthetic oligonucleotide
gggaggacgaugcgguuugucaacuuucuuuuccgcagacgacucgcccga

SEQ ID NO: 11085 - RNA, 51 nt, Artificial Sequence
  Description of Artificial Sequence: Synthetic oligonucleotide
gggaggacgaugcggauuuuugguauuuuuuaccgcagacgacucgcccga

SEQ ID NO: 11086 - RNA, 51 nt, Artificial Sequence
  Description of Artificial Sequence: Synthetic oligonucleotide
gggaggacgaugcgguuuauucuguuuuuuuuccgcagacgacucgcccga

SEQ ID NO: 11087 - RNA, 51 nt, Artificial Sequence
  Description of Artificial Sequence: Synthetic oligonucleotide
gggaggacgaugcggacucacguuuucuucuuccgcagacgacucgcccga

SEQ ID NO: 11088 - RNA, 51 nt, Artificial Sequence
  Description of Artificial Sequence: Synthetic oligonucleotide
gggaggacgaugcgguuacuuucuucucuuuuccccagacgacucgcccga

SEQ ID NO: 11089 - RNA, 52 nt, Artificial Sequence
  Description of Artificial Sequence: Synthetic oligonucleotide
gggaggacgaugcgguuuguuuuauuuuuuuguccccagacgacucgcccga

SEQ ID NO: 11090 - RNA, 51 nt, Artificial Sequence
  Description of Artificial Sequence: Synthetic oligonucleotide
gggaggacgaugcgguuucuuuuuuauuuccccugcagacgacucgcccga

SEQ ID NO: 11091 - RNA, 51 nt, Artificial Sequence
  Description of Artificial Sequence: Synthetic oligonucleotide
gggaggacgaugcggugagucacauuuuuuacccccagacgacucgcccga

SEQ ID NO: 11092 - RNA, 51 nt, Artificial Sequence
  Description of Artificial Sequence: Synthetic oligonucleotide
gggaggacgaugcgguuugggaguaggggguuccgcagacgacucgcccga

SEQ ID NO: 11093 - RNA, 51 nt, Artificial Sequence
  Description of Artificial Sequence: Synthetic oligonucleotide
gggaggacgaugcggauuucucacuucuuuuaccgcagacgacucgcccga

SEQ ID NO: 11094 - RNA, 51 nt, Artificial Sequence
  Description of Artificial Sequence: Synthetic oligonucleotide
gggaggacgaugcggcuuucuuuuccuuauuuccgcagacgacucgcccga

SEQ ID NO: 11095 - RNA, 51 nt, Artificial Sequence
  Description of Artificial Sequence: Synthetic oligonucleotide
gggaggacgaugcgguuuuuucacgguuuuuucugcagacgacucgcccga

SEQ ID NO: 11096 - RNA, 51 nt, Artificial Sequence
  Description of Artificial Sequence: Synthetic oligonucleotide
gggaggacgaugcgguuuugucuuuuccuuuuccgcagacgacucgcccga

SEQ ID NO: 11097 - RNA, 51 nt, Artificial Sequence
  Description of Artificial Sequence: Synthetic oligonucleotide
gggaggacgaugcggauuuucuuucuucuuuuccgcagacgacucgcccga

SEQ ID NO: 11098 - RNA, 51 nt, Artificial Sequence
  Description of Artificial Sequence: Synthetic oligonucleotide
gggaggacgaugcgguuuauuuuuucccguuugugcagacgacucgcccga

SEQ ID NO: 11099 - RNA, 51 nt, Artificial Sequence
  Description of Artificial Sequence: Synthetic oligonucleotide
gggaggacgaugcggucuuuuuugucuuucuuccgcagacgacucgcccga

SEQ ID NO: 11100 - RNA, 51 nt, Artificial Sequence
  Description of Artificial Sequence: Synthetic oligonucleotide
gggaggacgaugcgguuuauucauuucuuguuccccagacgacucgcccga

SEQ ID NO: 11101 - RNA, 51 nt, Artificial Sequence
  Description of Artificial Sequence: Synthetic oligonucleotide
gggaggacgaugcggauuuguuauuuuuguuugcccagacgacucgcccga

SEQ ID NO: 11102 - RNA, 51 nt, Artificial Sequence
  Description of Artificial Sequence: Synthetic oligonucleotide
gggaggacgaugcgggccugucgucuguucguccccagacgacucgcccga

SEQ ID NO: 11103 - RNA, 51 nt, Artificial Sequence
  Description of Artificial Sequence: Synthetic oligonucleotide
gggaggacgaugcggucuuuucauuuuucguuccgcagacgacucgcccga

SEQ ID NO: 11104 - RNA, 51 nt, Artificial Sequence
  Description of Artificial Sequence: Synthetic oligonucleotide
gggaggacgaugcgguuuuccguuccuuuuuuccgcagacgacucgcccga

SEQ ID NO: 11105 - RNA, 51 nt, Artificial Sequence
  Description of Artificial Sequence: Synthetic oligonucleotide
gggaggacgaugcggcuuuuucuuuucucuuuccgcagacgacucgcccga

SEQ ID NO: 11106 - RNA, 51 nt, Artificial Sequence
  Description of Artificial Sequence: Synthetic oligonucleotide
gggaggacgaugcgguucgcuuaucuuuauuuccgcagacgacucgcccga

SEQ ID NO: 11107 - RNA, 51 nt, Artificial Sequence
  Description of Artificial Sequence: Synthetic oligonucleotide
gggaggacgaugcgguauuuuuauuuucuccgccgcagacgacucgcccga

SEQ ID NO: 11108 - RNA, 51 nt, Artificial Sequence
  Description of Artificial Sequence: Synthetic oligonucleotide
gggaggacgaugcggcuucuaucuuuucucuaccgcagacgacucgcccga

SEQ ID NO: 11109 - RNA, 51 nt, Artificial Sequence
  Description of Artificial Sequence: Synthetic oligonucleotide
gggaggacgaugcggguuacuuucuuucuuuuccgcagacgacucgcccga

SEQ ID NO: 11110 - RNA, 51 nt, Artificial Sequence
  Description of Artificial Sequence: Synthetic oligonucleotide
gggaggacgaugcgguuuuauuucuuuuuuccccccagacgacucgcccga

SEQ ID NO: 11111 - RNA, 51 nt, Artificial Sequence
  Description of Artificial Sequence: Synthetic oligonucleotide
gggaggacgaugcggaguuuuugucuuuuuucccccagacgacucgcccga

SEQ ID NO: 11112 - RNA, 52 nt, Artificial Sequence
  Description of Artificial Sequence: Synthetic oligonucleotide
gggaggacgaugcggauuuucucuuuuuuucugccgcagacgacucgcccga

SEQ ID NO: 11113 - RNA, 51 nt, Artificial Sequence
  Description of Artificial Sequence: Synthetic oligonucleotide
gggaggacgaugcgguuuuacauucauuuuugcgccagacgacucgcccga

SEQ ID NO: 11114 - RNA, 51 nt, Artificial Sequence
  Description of Artificial Sequence: Synthetic oligonucleotide
gggaggacgaugcggccauucuuuuauuuucuccgcagacgacucgcccga

SEQ ID NO: 11115 - RNA, 51 nt, Artificial Sequence
  Description of Artificial Sequence: Synthetic oligonucleotide
gggaggacgaugcgguuuucauucuuuuuuucccccagacgacucgcccga

SEQ ID NO: 11116 - RNA, 51 nt, Artificial Sequence
  Description of Artificial Sequence: Synthetic oligonucleotide
gggaggacgaugcgguguuuuauuuguuuuuuccccagacgacucgcccga

SEQ ID NO: 11117 - RNA, 51 nt, Artificial Sequence
  Description of Artificial Sequence: Synthetic oligonucleotide
gggaggacgaugcgguuuucuucuugcuucuuccgcagacgacucgcccga

SEQ ID NO: 11118 - RNA, 51 nt, Artificial Sequence
  Description of Artificial Sequence: Synthetic oligonucleotide
gggaggacgaugcggauuuuuuguuguuuugaccgcagacgacucgcccga

SEQ ID NO: 11119 - RNA, 51 nt, Artificial Sequence
  Description of Artificial Sequence: Synthetic oligonucleotide
gggaggacgaugcgguuucacucuuuuuuccccgccagacgacucgcccga

SEQ ID NO: 11120 - RNA, 51 nt, Artificial Sequence
  Description of Artificial Sequence: Synthetic oligonucleotide
gggaggacgaugcggaauucuuuaucuuuccaccgcagacgacucgcccga

SEQ ID NO: 11121 - RNA, 51 nt, Artificial Sequence
  Description of Artificial Sequence: Synthetic oligonucleotide
gggaggacgaugcggauucacucuuuuccuugccgcagacgacucgcccga

SEQ ID NO: 11122 - RNA, 52 nt, Artificial Sequence
  Description of Artificial Sequence: Synthetic oligonucleotide
gggaggacgaugcggcaguuuuacuuuuucuuugcccagacgacucgcccga

SEQ ID NO: 11123 - RNA, 52 nt, Artificial Sequence
  Description of Artificial Sequence: Synthetic oligonucleotide
gggaggacgaugcggaauugcucuuuuuuucuaccgcagacgacucgcccga

SEQ ID NO: 11124 - RNA, 51 nt, Artificial Sequence
  Description of Artificial Sequence: Synthetic oligonucleotide
gggaggacgaugcggcauuuuauuauuucucuccgcagacgacucgcccga

SEQ ID NO: 11125 - RNA, 51 nt, Artificial Sequence
  Description of Artificial Sequence: Synthetic oligonucleotide
gggaggacgaugcggacuuuuuuucuuuucuaccgcagacgacucgcccga

SEQ ID NO: 11126 - RNA, 51 nt, Artificial Sequence
  Description of Artificial Sequence: Synthetic oligonucleotide
gggaggacgaugcgguuucuuuucauuuuuuuccgcagacgacucgcccga

SEQ ID NO: 11127 - RNA, 51 nt, Artificial Sequence
  Description of Artificial Sequence: Synthetic oligonucleotide
gggaggacgaugcggcucuuuuuucccuuucuccgcagacgacucgcccga

SEQ ID NO: 11128 - RNA, 51 nt, Artificial Sequence
  Description of Artificial Sequence: Synthetic oligonucleotide
gggaggacgaugcggcuuuacuuuuuauuuuuccgcagacgacucgcccga

SEQ ID NO: 11129 - RNA, 51 nt, Artificial Sequence
  Description of Artificial Sequence: Synthetic oligonucleotide
gggaggacgaugcgguccugucgucaguucguccccagacgacucgcccga

SEQ ID NO: 11130 - RNA, 51 nt, Artificial Sequence
  Description of Artificial Sequence: Synthetic oligonucleotide
gggaggacgaugcgguuuaucuuuaacuuuuuccgcagacgacucgcccga

SEQ ID NO: 11131 - RNA, 51 nt, Artificial Sequence
  Description of Artificial Sequence: Synthetic oligonucleotide
gggaggacgaugcgguuuucuaucuuuuuuguccgcagacgacucgcccga

SEQ ID NO: 11132 - RNA, 51 nt, Artificial Sequence
  Description of Artificial Sequence: Synthetic oligonucleotide
gggaggacgaugcggguucuuguuuccuuuuaccgcagacgacucgcccga

SEQ ID NO: 11133 - RNA, 51 nt, Artificial Sequence
  Description of Artificial Sequence: Synthetic oligonucleotide
gggaggacgaugcggcuuuuccuuuuuucacuccgcagacgacucgcccga

SEQ ID NO: 11134 - RNA, 51 nt, Artificial Sequence
  Description of Artificial Sequence: Synthetic oligonucleotide
gggaggacgaugcggucuacuauuuucuccauccgcagacgacucgcccga

SEQ ID NO: 11135 - RNA, 51 nt, Artificial Sequence
  Description of Artificial Sequence: Synthetic oligonucleotide
gggaggacgaugcgguuugcuuuauauuuuguccccagacgacucgcccga

SEQ ID NO: 11136 - RNA, 50 nt, Artificial Sequence
  Description of Artificial Sequence: Synthetic oligonucleotide
gggaggacgaugcgguccugucgucuguucuccccagacgacucgcccga

SEQ ID NO: 11137 - RNA, 51 nt, Artificial Sequence
  Description of Artificial Sequence: Synthetic oligonucleotide
gggaggacgaugcggccuuauuguucuuguuuccgcagacgacucgcccga

SEQ ID NO: 11138 - RNA, 51 nt, Artificial Sequence
  Description of Artificial Sequence: Synthetic oligonucleotide
gggaggacgaugcgguauuuacuuucuuuccuccgcagacgacucgcccga

SEQ ID NO: 11139 - RNA, 51 nt, Artificial Sequence
  Description of Artificial Sequence: Synthetic oligonucleotide
gggaggacgaugcggucucuuauguauucucuccgcagacgacucgcccga

SEQ ID NO: 11140 - RNA, 51 nt, Artificial Sequence
  Description of Artificial Sequence: Synthetic oligonucleotide
gggaggacgaugcgguuuuuuagucuauuuuuccgcagacgacucgcccga

SEQ ID NO: 11141 - RNA, 51 nt, Artificial Sequence
  Description of Artificial Sequence: Synthetic oligonucleotide
gggaggacgaugcggugaaggaggaggagggacugcagacgacucgcccga

SEQ ID NO: 11142 - RNA, 51 nt, Artificial Sequence
  Description of Artificial Sequence: Synthetic oligonucleotide
gggaggacgaugcgguuuucacuauauuuucuccgcagacgacucgcccga

SEQ ID NO: 11143 - RNA, 51 nt, Artificial Sequence
  Description of Artificial Sequence: Synthetic oligonucleotide
gggaggacgaugcggauucucuuuuuuucccaccgcagacgacucgcccga

SEQ ID NO: 11144 - RNA, 53 nt, Artificial Sequence
  Description of Artificial Sequence: Synthetic oligonucleotide
gggaggacgaugcgguuuuucucacaauucucauccgcagacgacucgcccga

SEQ ID NO: 11145 - RNA, 51 nt, Artificial Sequence
  Description of Artificial Sequence: Synthetic oligonucleotide
gggaggacgaugcggauucuuugauucuuuuuccgcagacgacucgcccga

SEQ ID NO: 11146 - RNA, 51 nt, Artificial Sequence
  Description of Artificial Sequence: Synthetic oligonucleotide
gggaggacgaugcgguuuccacgguuuuuuuuccgcagacgacucgcccga

SEQ ID NO: 11147 - RNA, 51 nt, Artificial Sequence
  Description of Artificial Sequence: Synthetic oligonucleotide
gggaggacgaugcggcuuauuuauuuuucucuccgcagacgacucgcccga

SEQ ID NO: 11148 - RNA, 51 nt, Artificial Sequence
  Description of Artificial Sequence: Synthetic oligonucleotide
gggaggacgaugcgguuuguuuucuugauuuuccccagacgacucgcccga

SEQ ID NO: 11149 - RNA, 53 nt, Artificial Sequence
  Description of Artificial Sequence: Synthetic oligonucleotide
gggaggacgaugcggaauuauguguuuuuuugugccgcagacgacucgcccga

SEQ ID NO: 11150 - RNA, 51 nt, Artificial Sequence
  Description of Artificial Sequence: Synthetic oligonucleotide
gggaggacgaugcggcuuucucuucucuucuuccgcagacgacucgcccga

SEQ ID NO: 11151 - RNA, 51 nt, Artificial Sequence
  Description of Artificial Sequence: Synthetic oligonucleotide
gggaggacgaugcggcuuucuuuguuuccucuccgcagacgacucgcccga

SEQ ID NO: 11152 - RNA, 51 nt, Artificial Sequence
  Description of Artificial Sequence: Synthetic oligonucleotide
gggaggacgaugcggucuuuuaacaccuuuuuccgcagacgacucgcccga

SEQ ID NO: 11153 - RNA, 51 nt, Artificial Sequence
  Description of Artificial Sequence: Synthetic oligonucleotide
gggaggacgaugcgguuguuucuaccuuuuuuccgcagacgacucgcccga

SEQ ID NO: 11154 - RNA, 51 nt, Artificial Sequence
  Description of Artificial Sequence: Synthetic oligonucleotide
gggaggacgaugcggucuguuuuacuuuuuuuccccagacgacucgcccga

SEQ ID NO: 11155 - RNA, 51 nt, Artificial Sequence
  Description of Artificial Sequence: Synthetic oligonucleotide
gggaggacgaugcgguuuuauacuguuuuucccgccagacgacucgcccga

SEQ ID NO: 11156 - RNA, 51 nt, Artificial Sequence
  Description of Artificial Sequence: Synthetic oligonucleotide
gggaggacgaugcggcuuuuucaacuucuuuuccgcagacgacucgcccga

SEQ ID NO: 11157 - RNA, 51 nt, Artificial Sequence
  Description of Artificial Sequence: Synthetic oligonucleotide
gggaggacgaugcggauuuuucuccuuuuucaccgcagacgacucgcccga

SEQ ID NO: 11158 - RNA, 51 nt, Artificial Sequence
  Description of Artificial Sequence: Synthetic oligonucleotide
gggaggacgaugcggucuuuauaucacuuuuuccgcagacgacucgcccga

SEQ ID NO: 11159 - RNA, 51 nt, Artificial Sequence
  Description of Artificial Sequence: Synthetic oligonucleotide
gggaggacgaugcgguuucuaaucuccuuuuuccgcagacgacucgcccga

SEQ ID NO: 11160 - RNA, 51 nt, Artificial Sequence
  Description of Artificial Sequence: Synthetic oligonucleotide
gggaggacgaugcgguacuucuuuuuuucucuccgcagacgacucgcccga

SEQ ID NO: 11161 - RNA, 51 nt, Artificial Sequence
  Description of Artificial Sequence: Synthetic oligonucleotide
gggaggacgaugcggaccuuaucuccuuuucuccgcagacgacucgcccga

SEQ ID NO: 11162 - RNA, 51 nt, Artificial Sequence
  Description of Artificial Sequence: Synthetic oligonucleotide
gggaggacgaugcggaucuuuucccgcuuuuuccgcagacgacucgcccga

SEQ ID NO: 11163 - RNA, 52 nt, Artificial Sequence
  Description of Artificial Sequence: Synthetic oligonucleotide
gggaggacgaugcgguuuuuccauauucucuguccgcagacgacucgcccga

SEQ ID NO: 11164 - RNA, 51 nt, Artificial Sequence
  Description of Artificial Sequence: Synthetic oligonucleotide
gggaggacgaugcgguuugggaguagggcguuccgcagacgacucgcccga

SEQ ID NO: 11165 - RNA, 51 nt, Artificial Sequence
  Description of Artificial Sequence: Synthetic oligonucleotide
gggaggacgaugcggaucuuuuuguuuuuccuccgcagacgacucgcccga

SEQ ID NO: 11166 - RNA, 51 nt, Artificial Sequence
  Description of Artificial Sequence: Synthetic oligonucleotide
gggaggacgaugcggucucuuuucuuucuuauccgcagacgacucgcccga

SEQ ID NO: 11167 - RNA, 51 nt, Artificial Sequence
  Description of Artificial Sequence: Synthetic oligonucleotide
gggaggacgaugcggacuucuuuauuuuucuuccgcagacgacucgcccga

SEQ ID NO: 11168 - RNA, 51 nt, Artificial Sequence
  Description of Artificial Sequence: Synthetic oligonucleotide
gggaggacgaugcggcauucuuaucucuuucuccgcagacgacucgcccga

SEQ ID NO: 11169 - RNA, 51 nt, Artificial Sequence
  Description of Artificial Sequence: Synthetic oligonucleotide
gggaggacgaugcggaauuccuuucuucuuuaccgcagacgacucgcccga

SEQ ID NO: 11170 - RNA, 51 nt, Artificial Sequence
  Description of Artificial Sequence: Synthetic oligonucleotide
gggaggacgaugcgguccuugucgucuuucguccccagacgacucgcccga

SEQ ID NO: 11171 - RNA, 51 nt, Artificial Sequence
  Description of Artificial Sequence: Synthetic oligonucleotide
gggaggacgaugcggucucuuuaccuuucuugccgcagacgacucgcccga

SEQ ID NO: 11172 - RNA, 51 nt, Artificial Sequence
  Description of Artificial Sequence: Synthetic oligonucleotide
gggaggacgaugcggcuugggaguaggguguuccgcagacgacucgcccga

SEQ ID NO: 11173 - RNA, 51 nt, Artificial Sequence
  Description of Artificial Sequence: Synthetic oligonucleotide
gggaggacgaugcgguacuuaucucucucuuuccgcagacgacucgcccga

SEQ ID NO: 11174 - RNA, 51 nt, Artificial Sequence
  Description of Artificial Sequence: Synthetic oligonucleotide
gggaggacgaugcgguucuuuucucguuuauuccgcagacgacucgcccga

SEQ ID NO: 11175 - RNA, 52 nt, Artificial Sequence
  Description of Artificial Sequence: Synthetic oligonucleotide
gggaggacgaugcgguuuuuguuacguuuuuuugcgcagacgacucgcccga

SEQ ID NO: 11176 - RNA, 51 nt, Artificial Sequence
  Description of Artificial Sequence: Synthetic oligonucleotide
gggaggacgaugcggacuuucacugcuuuuugccgcagacgacucgcccga

SEQ ID NO: 11177 - RNA, 51 nt, Artificial Sequence
  Description of Artificial Sequence: Synthetic oligonucleotide
gggaggacgaugcggaucuuuguauuucuuuaccgcagacgacucgcccga

SEQ ID NO: 11178 - RNA, 51 nt, Artificial Sequence
  Description of Artificial Sequence: Synthetic oligonucleotide
gggaggacgaugcggcuucuucauuuuucuuuccgcagacgacucgcccga

SEQ ID NO: 11179 - RNA, 50 nt, Artificial Sequence
  Description of Artificial Sequence: Synthetic oligonucleotide
gggaggacgaugcgguuucuuuccuuauuuuccgcagacgacucgcccga

SEQ ID NO: 11180 - RNA, 51 nt, Artificial Sequence
  Description of Artificial Sequence: Synthetic oligonucleotide
gggaggacgaugcggauuucuuuccacucuuuccgcagacgacucgcccga

SEQ ID NO: 11181 - RNA, 51 nt, Artificial Sequence
  Description of Artificial Sequence: Synthetic oligonucleotide
gggaggacgaugcggauuuuauccuucuucugccgcagacgacucgcccga

SEQ ID NO: 11182 - RNA, 51 nt, Artificial Sequence
  Description of Artificial Sequence: Synthetic oligonucleotide
gggaggacgaugcgguuuuucaccuuuugcuuccgcagacgacucgcccga

SEQ ID NO: 11183 - RNA, 51 nt, Artificial Sequence
  Description of Artificial Sequence: Synthetic oligonucleotide
gggaggacgaugcggcuuacuuuucgcuucuuccgcagacgacucgcccga

SEQ ID NO: 11184 - RNA, 51 nt, Artificial Sequence
  Description of Artificial Sequence: Synthetic oligonucleotide
gggaggacgaugcgguucauucuuucuuuucugcccagacgacucgcccga

SEQ ID NO: 11185 - RNA, 51 nt, Artificial Sequence
  Description of Artificial Sequence: Synthetic oligonucleotide
gggaggacgaugcgguucacuacuuauuucuuccgcagacgacucgcccga

SEQ ID NO: 11186 - RNA, 51 nt, Artificial Sequence
  Description of Artificial Sequence: Synthetic oligonucleotide
gggaggacgaugcgguuucacuauuucuuucccgccagacgacucgcccga

SEQ ID NO: 11187 - RNA, 51 nt, Artificial Sequence
  Description of Artificial Sequence: Synthetic oligonucleotide
gggaggacgaugcgguauuauuguuucuuuccccgcagacgacucgcccga

SEQ ID NO: 11188 - RNA, 51 nt, Artificial Sequence
  Description of Artificial Sequence: Synthetic oligonucleotide
gggaggacgaugcgguacuuuuguuucuuuuuccgcagacgacucgcccga

SEQ ID NO: 11189 - RNA, 51 nt, Artificial Sequence
  Description of Artificial Sequence: Synthetic oligonucleotide
gggaggacgaugcgguuuuacuuguuuuuuguccgcagacgacucgcccga

SEQ ID NO: 11190 - RNA, 51 nt, Artificial Sequence
  Description of Artificial Sequence: Synthetic oligonucleotide
gggaggacgaugcggaucuugcugcuuuuuuaccgcagacgacucgcccga

SEQ ID NO: 11191 - RNA, 51 nt, Artificial Sequence
  Description of Artificial Sequence: Synthetic oligonucleotide
gggaggacgaugcggauauuucuucuucuuuaccgcagacgacucgcccga

SEQ ID NO: 11192 - RNA, 51 nt, Artificial Sequence
  Description of Artificial Sequence: Synthetic oligonucleotide
gggaggacgaugcgguucgugcuuuucuuucuccgcagacgacucgcccga

SEQ ID NO: 11193 - RNA, 51 nt, Artificial Sequence
  Description of Artificial Sequence: Synthetic oligonucleotide
gggaggacgaugcgguuuguguuuuucuuguuccgcagacgacucgcccga

SEQ ID NO: 11194 - RNA, 51 nt, Artificial Sequence
  Description of Artificial Sequence: Synthetic oligonucleotide
gggaggacgaugcggccauuacuuuuucccauccgcagacgacucgcccga

SEQ ID NO: 11195 - RNA, 51 nt, Artificial Sequence
  Description of Artificial Sequence: Synthetic oligonucleotide
gggaggacgaugcggguuuucucuccuuuguuccgcagacgacucgcccga

SEQ ID NO: 11196 - RNA, 51 nt, Artificial Sequence
  Description of Artificial Sequence: Synthetic oligonucleotide
gggaggacgaugcgguucguuuuuacucuuuuccgcagacgacucgcccga

SEQ ID NO: 11197 - RNA, 50 nt, Artificial Sequence
  Description of Artificial Sequence: Synthetic oligonucleotide
gggaggacgaugcgguuucuuauuauucucuccgcagacgacucgcccga

SEQ ID NO: 11198 - RNA, 51 nt, Artificial Sequence
  Description of Artificial Sequence: Synthetic oligonucleotide
gggaggacgaugcgguuuguucuuuucuuuucccccagacgacucgcccga

SEQ ID NO: 11199 - RNA, 51 nt, Artificial Sequence
  Description of Artificial Sequence: Synthetic oligonucleotide
gggaggacgaugcggcuuucuuacacuuugcuccgcagacgacucgcccga

SEQ ID NO: 11200 - RNA, 51 nt, Artificial Sequence
  Description of Artificial Sequence: Synthetic oligonucleotide
gggaggacgaugcgguucuuuucucucuucguccgcagacgacucgcccga

SEQ ID NO: 11201 - RNA, 51 nt, Artificial Sequence
  Description of Artificial Sequence: Synthetic oligonucleotide
gggaggacgaugcgggacuuuccuuucuuuuuccccagacgacucgcccga

SEQ ID NO: 11202 - RNA, 51 nt, Artificial Sequence
  Description of Artificial Sequence: Synthetic oligonucleotide
gggaggacgaugcgguuucucuuacauuucuuccgcagacgacucgcccga

SEQ ID NO: 11203 - RNA, 51 nt, Artificial Sequence
  Description of Artificial Sequence: Synthetic oligonucleotide
gggaggacgaugcgguuuuauuuguuguuuguuggcagacgacucgcccga

SEQ ID NO: 11204 - RNA, 51 nt, Artificial Sequence
  Description of Artificial Sequence: Synthetic oligonucleotide
gggaggacgaugcggucuuuuguucacuaucuccgcagacgacucgcccga

SEQ ID NO: 11205 - RNA, 51 nt, Artificial Sequence
  Description of Artificial Sequence: Synthetic oligonucleotide
gggaggacgaugcggcuuuucucaauuucgcuccgcagacgacucgcccga

SEQ ID NO: 11206 - RNA, 51 nt, Artificial Sequence
  Description of Artificial Sequence: Synthetic oligonucleotide
gggaggacgaugcggacaucuuuucuuuccuaccgcagacgacucgcccga

SEQ ID NO: 11207 - RNA, 51 nt, Artificial Sequence
  Description of Artificial Sequence: Synthetic oligonucleotide
gggaggacgaugcgguucuuuucuuacuccuuccgcagacgacucgcccga

SEQ ID NO: 11208 - RNA, 51 nt, Artificial Sequence
  Description of Artificial Sequence: Synthetic oligonucleotide
gggaggacgaugcgguuuguucuucuuauuccccgcagacgacucgcccga

SEQ ID NO: 11209 - RNA, 51 nt, Artificial Sequence
  Description of Artificial Sequence: Synthetic oligonucleotide
gggaggacgaugcgguauuuuguuuucuguuugcgcagacgacucgcccga

SEQ ID NO: 11210 - RNA, 51 nt, Artificial Sequence
  Description of Artificial Sequence: Synthetic oligonucleotide
gggaggacgaugcggauuuggucucuuuuucgccgcagacgacucgcccga

SEQ ID NO: 11211 - RNA, 51 nt, Artificial Sequence
  Description of Artificial Sequence: Synthetic oligonucleotide
gggaggacgaugcgguuuguuuauuccuuuuuccgcagacgacucgcccga

SEQ ID NO: 11212 - RNA, 51 nt, Artificial Sequence
  Description of Artificial Sequence: Synthetic oligonucleotide
gggaggacgaugcggcuucuuguuuugucuuuccgcagacgacucgcccga

SEQ ID NO: 11213 - RNA, 51 nt, Artificial Sequence
  Description of Artificial Sequence: Synthetic oligonucleotide
gggaggacgaugcgguuuuaucuucuuuugugccgcagacgacucgcccga

SEQ ID NO: 11214 - RNA, 51 nt, Artificial Sequence
  Description of Artificial Sequence: Synthetic oligonucleotide
gggaggacgaugcgguuccguucacuuuuuuuccgcagacgacucgcccga

SEQ ID NO: 11215 - RNA, 53 nt, Artificial Sequence
  Description of Artificial Sequence: Synthetic oligonucleotide
gggaggacgaugcgguuuuucguguuuuuuugcaccgcagacgacucgcccga

SEQ ID NO: 11216 - RNA, 51 nt, Artificial Sequence
  Description of Artificial Sequence: Synthetic oligonucleotide
gggaggacgaugcggcauuauuauuuuucgcuccgcagacgacucgcccga

SEQ ID NO: 11217 - RNA, 51 nt, Artificial Sequence
  Description of Artificial Sequence: Synthetic oligonucleotide
gggaggacgaugcgguuuguuucucuuugucucugcagacgacucgcccga

SEQ ID NO: 11218 - RNA, 51 nt, Artificial Sequence
  Description of Artificial Sequence: Synthetic oligonucleotide
gggaggacgaugcggacuucuuacuuuuuccuccgcagacgacucgcccga

SEQ ID NO: 11219 - RNA, 51 nt, Artificial Sequence
  Description of Artificial Sequence: Synthetic oligonucleotide
gggaggacgaugcggacuuucuucucuuuuugccgcagacgacucgcccga

SEQ ID NO: 11220 - RNA, 51 nt, Artificial Sequence
  Description of Artificial Sequence: Synthetic oligonucleotide
gggaggacgaugcggcuuuuuuguucuuucauccgcagacgacucgcccga

SEQ ID NO: 11221 - RNA, 51 nt, Artificial Sequence
  Description of Artificial Sequence: Synthetic oligonucleotide
gggaggacgaugcgguuuuugucuacuuuuuaccgcagacgacucgcccga

SEQ ID NO: 11222 - RNA, 53 nt, Artificial Sequence
  Description of Artificial Sequence: Synthetic oligonucleotide
gggaggacgaugcgguuuguacgcguuuuuuuguccgcagacgacucgcccga

SEQ ID NO: 11223 - RNA, 51 nt, Artificial Sequence
  Description of Artificial Sequence: Synthetic oligonucleotide
gggaggacgaugcggcuuuuucguuuuuucuuccgcagacgacucgcccga

SEQ ID NO: 11224 - RNA, 51 nt, Artificial Sequence
  Description of Artificial Sequence: Synthetic oligonucleotide
gggaggacgaugcgguuuuacuuuaucucuuugugcagacgacucgcccga

SEQ ID NO: 11225 - RNA, 49 nt, Artificial Sequence
  Description of Artificial Sequence: Synthetic oligonucleotide
gggaggacgaugcgguccugucgucuguucccccagacgacucgcccga

SEQ ID NO: 11226 - RNA, 50 nt, Artificial Sequence
  Description of Artificial Sequence: Synthetic oligonucleotide
gggaggacgaugcggccugucgucuguucguccccagacgacucgcccga

SEQ ID NO: 11227 - RNA, 51 nt, Artificial Sequence
  Description of Artificial Sequence: Synthetic oligonucleotide
gggaggacgaugcggucuuuucucucuucucaccgcagacgacucgcccga

SEQ ID NO: 11228 - RNA, 51 nt, Artificial Sequence
  Description of Artificial Sequence: Synthetic oligonucleotide
gggaggacgaugcgguuuggggguaggguguuccgcagacgacucgcccga

SEQ ID NO: 11229 - RNA, 51 nt, Artificial Sequence
  Description of Artificial Sequence: Synthetic oligonucleotide
gggaggacgaugcggguuuuuguuauuguuuugcccagacgacucgcccga

SEQ ID NO: 11230 - RNA, 52 nt, Artificial Sequence
  Description of Artificial Sequence: Synthetic oligonucleotide
gggaggacgaugcggcuuucacuuuuuuucccuccgcagacgacucgcccga

SEQ ID NO: 11231 - RNA, 51 nt, Artificial Sequence
  Description of Artificial Sequence: Synthetic oligonucleotide
gggaggacgaugcggguucuuugucuuuucucccgcagacgacucgcccga

SEQ ID NO: 11232 - RNA, 51 nt, Artificial Sequence
  Description of Artificial Sequence: Synthetic oligonucleotide
gggaggacgaugcggguuuuguauucuuuuucccccagacgacucgcccga

SEQ ID NO: 11233 - RNA, 50 nt, Artificial Sequence
  Description of Artificial Sequence: Synthetic oligonucleotide
gggaggacgaugcggccuuuuacuuuuuucuccgcagacgacucgcccga

SEQ ID NO: 11234 - RNA, 51 nt, Artificial Sequence
  Description of Artificial Sequence: Synthetic oligonucleotide
gggaggacgaugcggcuauuuacuuuccuucuccgcagacgacucgcccga

SEQ ID NO: 11235 - RNA, 51 nt, Artificial Sequence
  Description of Artificial Sequence: Synthetic oligonucleotide
gggaggacgaugcgguuuguucugucuuauuuccgcagacgacucgcccga

SEQ ID NO: 11236 - RNA, 52 nt, Artificial Sequence
  Description of Artificial Sequence: Synthetic oligonucleotide
gggaggacgaugcgguugugcguuuuuuuuuugccgcagacgacucgcccga

SEQ ID NO: 11237 - RNA, 51 nt, Artificial Sequence
  Description of Artificial Sequence: Synthetic oligonucleotide
gggaggacgaugcggucucuuuaauucuucuuccgcagacgacucgcccga

SEQ ID NO: 11238 - RNA, 51 nt, Artificial Sequence
  Description of Artificial Sequence: Synthetic oligonucleotide
gggaggacgaugcgguauuucucuuuacuuuuccccagacgacucgcccga

SEQ ID NO: 11239 - RNA, 52 nt, Artificial Sequence
  Description of Artificial Sequence: Synthetic oligonucleotide
gggaggacgaugcgguauuuuacguuuuuuucgcugcagacgacucgcccga

SEQ ID NO: 11240 - RNA, 50 nt, Artificial Sequence
  Description of Artificial Sequence: Synthetic oligonucleotide
gggaggacgaugcgguccugucgucguucguccccagacgacucgcccga

SEQ ID NO: 11241 - RNA, 51 nt, Artificial Sequence
  Description of Artificial Sequence: Synthetic oligonucleotide
gggaggacgaugcggcaccuuuucuuucuucuccgcagacgacucgcccga

SEQ ID NO: 11242 - RNA, 51 nt, Artificial Sequence
  Description of Artificial Sequence: Synthetic oligonucleotide
gggaggacgaugcggcuuucucuuugucuuuuccgcagacgacucgcccga

SEQ ID NO: 11243 - RNA, 51 nt, Artificial Sequence
  Description of Artificial Sequence: Synthetic oligonucleotide
gggaggacgaugcggucuuucuucuuuuaucuccgcagacgacucgcccga

SEQ ID NO: 11244 - RNA, 51 nt, Artificial Sequence
  Description of Artificial Sequence: Synthetic oligonucleotide
gggaggacgaugcggguuuuuauucuuuuuccccccagacgacucgcccga

SEQ ID NO: 11245 - RNA, 51 nt, Artificial Sequence
  Description of Artificial Sequence: Synthetic oligonucleotide
gggaggacgaugcgggcuucuuuucucuuuuuccccagacgacucgcccga

SEQ ID NO: 11246 - RNA, 51 nt, Artificial Sequence
  Description of Artificial Sequence: Synthetic oligonucleotide
gggaggacgaugcgguuuacuuuuuuauugcucugcagacgacucgcccga

SEQ ID NO: 11247 - RNA, 51 nt, Artificial Sequence
  Description of Artificial Sequence: Synthetic oligonucleotide
gggaggacgaugcgguguuuuacuauuuuuucccgcagacgacucgcccga

SEQ ID NO: 11248 - RNA, 51 nt, Artificial Sequence
  Description of Artificial Sequence: Synthetic oligonucleotide
gggaggacgaugcggaauuuccuucucuucuaccgcagacgacucgcccga

SEQ ID NO: 11249 - RNA, 51 nt, Artificial Sequence
  Description of Artificial Sequence: Synthetic oligonucleotide
gggaggacgaugcgguuuauuucgcguuuucuccgcagacgacucgcccga

SEQ ID NO: 11250 - RNA, 51 nt, Artificial Sequence
  Description of Artificial Sequence: Synthetic oligonucleotide
gggaggacgaugcggguuucuucacuuuucuuccgcagacgacucgcccga

SEQ ID NO: 11251 - RNA, 53 nt, Artificial Sequence
  Description of Artificial Sequence: Synthetic oligonucleotide
gggaggacgaugcggcuuucacuuuuuuuucucuccgcagacgacucgcccga

SEQ ID NO: 11252 - RNA, 51 nt, Artificial Sequence
  Description of Artificial Sequence: Synthetic oligonucleotide
gggaggacgaugcggauauuauuuuucucucgccgcagacgacucgcccga

SEQ ID NO: 11253 - RNA, 51 nt, Artificial Sequence
  Description of Artificial Sequence: Synthetic oligonucleotide
gggaggacgaugcgguuucuuuauucauuccuccgcagacgacucgcccga

SEQ ID NO: 11254 - RNA, 51 nt, Artificial Sequence
  Description of Artificial Sequence: Synthetic oligonucleotide
gggaggacgaugcggccuuuuucguuuucuauccgcagacgacucgcccga

SEQ ID NO: 11255 - RNA, 52 nt, Artificial Sequence
  Description of Artificial Sequence: Synthetic oligonucleotide
gggaggacgaugcggauuucacugucuuuuuucccgcagacgacucgcccga

SEQ ID NO: 11256 - RNA, 52 nt, Artificial Sequence
  Description of Artificial Sequence: Synthetic oligonucleotide
gggaggacgaugcggacauuuuguuacuuuuuacugcagacgacucgcccga

SEQ ID NO: 11257 - RNA, 52 nt, Artificial Sequence
  Description of Artificial Sequence: Synthetic oligonucleotide
gggaggacgaugcgguuucuugucuauuuuuuuccgcagacgacucgcccga

SEQ ID NO: 11258 - RNA, 53 nt, Artificial Sequence
  Description of Artificial Sequence: Synthetic oligonucleotide
gggaggacgaugcgguugugcguuuuuuuuuuugccgcagacgacucgcccga

SEQ ID NO: 11259 - RNA, 51 nt, Artificial Sequence
  Description of Artificial Sequence: Synthetic oligonucleotide
gggaggacgaugcgguuuuccaagcuuucucuccgcagacgacucgcccga

SEQ ID NO: 11260 - RNA, 51 nt, Artificial Sequence
  Description of Artificial Sequence: Synthetic oligonucleotide
gggaggacgaugcggauuucuuuguuucuuugccccagacgacucgcccga

SEQ ID NO: 11261 - RNA, 51 nt, Artificial Sequence
  Description of Artificial Sequence: Synthetic oligonucleotide
gggaggacgaugcgguauuuuacguuuuuucgcugcagacgacucgcccga

SEQ ID NO: 11262 - RNA, 51 nt, Artificial Sequence
  Description of Artificial Sequence: Synthetic oligonucleotide
gggaggacgaugcgguucucuuuuucuuuucaccgcagacgacucgcccga

SEQ ID NO: 11263 - RNA, 51 nt, Artificial Sequence
  Description of Artificial Sequence: Synthetic oligonucleotide
gggaggacgaugcgguuucacacuuuuuuuugcugcagacgacucgcccga

SEQ ID NO: 11264 - RNA, 51 nt, Artificial Sequence
  Description of Artificial Sequence: Synthetic oligonucleotide
gggaggacgaugcggauuuuguuauauuguugccgcagacgacucgcccga

SEQ ID NO: 11265 - RNA, 51 nt, Artificial Sequence
  Description of Artificial Sequence: Synthetic oligonucleotide
gggaggacgaugcggcuauuuucucucuuacuccgcagacgacucgcccga

SEQ ID NO: 11266 - RNA, 51 nt, Artificial Sequence
  Description of Artificial Sequence: Synthetic oligonucleotide
gggaggacgaugcgguucacuacucuuuuucuccgcagacgacucgcccga

SEQ ID NO: 11267 - RNA, 51 nt, Artificial Sequence
  Description of Artificial Sequence: Synthetic oligonucleotide
gggaggacgaugcggcuuuucucgauuacuuuccgcagacgacucgcccga

SEQ ID NO: 11268 - RNA, 51 nt, Artificial Sequence
  Description of Artificial Sequence: Synthetic oligonucleotide
gggaggacgaugcgguauuuucuaugcuuuuuccgcagacgacucgcccga

SEQ ID NO: 11269 - RNA, 51 nt, Artificial Sequence
  Description of Artificial Sequence: Synthetic oligonucleotide
gggaggacgaugcgguacuuuuauucuuuuuuccccagacgacucgcccga

SEQ ID NO: 11270 - RNA, 51 nt, Artificial Sequence
  Description of Artificial Sequence: Synthetic oligonucleotide
gggaggacgaugcgguuuuucucucuaucgcuccgcagacgacucgcccga

SEQ ID NO: 11271 - RNA, 51 nt, Artificial Sequence
  Description of Artificial Sequence: Synthetic oligonucleotide
gggaggacgaugcggaauucuuuucuucucguccgcagacgacucgcccga

SEQ ID NO: 11272 - RNA, 51 nt, Artificial Sequence
  Description of Artificial Sequence: Synthetic oligonucleotide
gggaggacgaugcggauuuccguucauuuuugccgcagacgacucgcccga

SEQ ID NO: 11273 - RNA, 51 nt, Artificial Sequence
  Description of Artificial Sequence: Synthetic oligonucleotide
gggaggacgaugcgguuugucauuuuucuuguccgcagacgacucgcccga

SEQ ID NO: 11274 - RNA, 51 nt, Artificial Sequence
  Description of Artificial Sequence: Synthetic oligonucleotide
gggaggacgaugcggucuucaacuuuucuuuuccgcagacgacucgcccga

SEQ ID NO: 11275 - RNA, 51 nt, Artificial Sequence
  Description of Artificial Sequence: Synthetic oligonucleotide
gggaggacgaugcggaccacuauuuucuuuuuccgcagacgacucgcccga

SEQ ID NO: 11276 - RNA, 51 nt, Artificial Sequence
  Description of Artificial Sequence: Synthetic oligonucleotide
gggaggacgaugcgguucuuguuuacuuuuuuccccagacgacucgcccga

SEQ ID NO: 11277 - RNA, 52 nt, Artificial Sequence
  Description of Artificial Sequence: Synthetic oligonucleotide
gggaggacgaugcggaguuuucuuuuugcuuuucugcagacgacucgcccga

SEQ ID NO: 11278 - RNA, 53 nt, Artificial Sequence
  Description of Artificial Sequence: Synthetic oligonucleotide
gggaggacgaugcggaauuauguuuuuuuugugaccgcagacgacucgcccga

SEQ ID NO: 11279 - RNA, 51 nt, Artificial Sequence
  Description of Artificial Sequence: Synthetic oligonucleotide
gggaggacgaugcggugucuuugcuuuuuguuccgcagacgacucgcccga

SEQ ID NO: 11280 - RNA, 51 nt, Artificial Sequence
  Description of Artificial Sequence: Synthetic oligonucleotide
gggaggacgaugcgguucuugcucuuuuuccuccgcagacgacucgcccga

SEQ ID NO: 11281 - RNA, 51 nt, Artificial Sequence
  Description of Artificial Sequence: Synthetic oligonucleotide
gggaggacgaugcgguucuacuuguuuuucccccgcagacgacucgcccga

SEQ ID NO: 11282 - RNA, 51 nt, Artificial Sequence
  Description of Artificial Sequence: Synthetic oligonucleotide
gggaggacgaugcggucuuuuuguauucuucuccgcagacgacucgcccga

SEQ ID NO: 11283 - RNA, 51 nt, Artificial Sequence
  Description of Artificial Sequence: Synthetic oligonucleotide
gggaggacgaugcgguuuucauacuuuuucccccgcagacgacucgcccga

SEQ ID NO: 11284 - RNA, 51 nt, Artificial Sequence
  Description of Artificial Sequence: Synthetic oligonucleotide
gggaggacgaugcgguuauuuuuguuuuuugcgugcagacgacucgcccga

SEQ ID NO: 11285 - RNA, 51 nt, Artificial Sequence
  Description of Artificial Sequence: Synthetic oligonucleotide
gggaggacgaugcgguuugggguuuucccuugccccagacgacucgcccga

SEQ ID NO: 11286 - RNA, 51 nt, Artificial Sequence
  Description of Artificial Sequence: Synthetic oligonucleotide
gggaggacgaugcggauuuuuuauuuccugugccgcagacgacucgcccga

SEQ ID NO: 11287 - RNA, 51 nt, Artificial Sequence
  Description of Artificial Sequence: Synthetic oligonucleotide
gggaggacgaugcggaucuucuuauucuuucgccgcagacgacucgcccga

SEQ ID NO: 11288 - RNA, 51 nt, Artificial Sequence
  Description of Artificial Sequence: Synthetic oligonucleotide
gggaggacgaugcggucuuuuuauuugugucuccgcagacgacucgcccga

SEQ ID NO: 11289 - RNA, 51 nt, Artificial Sequence
  Description of Artificial Sequence: Synthetic oligonucleotide
gggaggacgaugcgguuucuauauccuucuuuccgcagacgacucgcccga

SEQ ID NO: 11290 - RNA, 51 nt, Artificial Sequence
  Description of Artificial Sequence: Synthetic oligonucleotide
gggaggacgaugcgggacuuucuuuuucuuuuccccagacgacucgcccga

SEQ ID NO: 11291 - RNA, 51 nt, Artificial Sequence
  Description of Artificial Sequence: Synthetic oligonucleotide
gggaggacgaugcggcuuuugucuuuuucuuuccgcagacgacucgcccga

SEQ ID NO: 11292 - RNA, 51 nt, Artificial Sequence
  Description of Artificial Sequence: Synthetic oligonucleotide
gggaggacgaugcggauuccacuuuuuuuucaccgcagacgacucgcccga

SEQ ID NO: 11293 - RNA, 51 nt, Artificial Sequence
  Description of Artificial Sequence: Synthetic oligonucleotide
gggaggacgaugcgguuuauuucuuuuuaucuccgcagacgacucgcccga

SEQ ID NO: 11294 - RNA, 52 nt, Artificial Sequence
  Description of Artificial Sequence: Synthetic oligonucleotide
gggaggacgaugcggccuuuuacuuuuuuuucuccgcagacgacucgcccga

SEQ ID NO: 11295 - RNA, 52 nt, Artificial Sequence
  Description of Artificial Sequence: Synthetic oligonucleotide
gggaggacgaugcgguuuguuguuguuuuuuuucugcagacgacucgcccga

SEQ ID NO: 11296 - RNA, 51 nt, Artificial Sequence
  Description of Artificial Sequence: Synthetic oligonucleotide
gggaggacgaugcgguuuuuuuauuguuguuucugcagacgacucgcccga

SEQ ID NO: 11297 - RNA, 51 nt, Artificial Sequence
  Description of Artificial Sequence: Synthetic oligonucleotide
gggaggacgaugcgguuuggggguuucccgugccccagacgacucgcccga

SEQ ID NO: 11298 - RNA, 51 nt, Artificial Sequence
  Description of Artificial Sequence: Synthetic oligonucleotide
gggaggacgaugcgguauucuucuucuuaccuccgcagacgacucgcccga

SEQ ID NO: 11299 - RNA, 51 nt, Artificial Sequence
  Description of Artificial Sequence: Synthetic oligonucleotide
gggaggacgaugcggauucuucuacucuuauuccgcagacgacucgcccga

SEQ ID NO: 11300 - RNA, 51 nt, Artificial Sequence
  Description of Artificial Sequence: Synthetic oligonucleotide
gggaggacgaugcggguucuuacuuuaucuugccgcagacgacucgcccga

SEQ ID NO: 11301 - RNA, 51 nt, Artificial Sequence
  Description of Artificial Sequence: Synthetic oligonucleotide
gggaggacgaugcggauuuucaugucccuuuaccgcagacgacucgcccga

SEQ ID NO: 11302 - RNA, 51 nt, Artificial Sequence
  Description of Artificial Sequence: Synthetic oligonucleotide
gggaggacgaugcggauuuucaacuccuuuucccgcagacgacucgcccga

SEQ ID NO: 11303 - RNA, 51 nt, Artificial Sequence
  Description of Artificial Sequence: Synthetic oligonucleotide
gggaggacgaugcggcuauuauccuuuucuuuccgcagacgacucgcccga

SEQ ID NO: 11304 - RNA, 51 nt, Artificial Sequence
  Description of Artificial Sequence: Synthetic oligonucleotide
gggaggacgaugcggcuuucuuuucacuucuuccgcagacgacucgcccga

SEQ ID NO: 11305 - RNA, 51 nt, Artificial Sequence
  Description of Artificial Sequence: Synthetic oligonucleotide
gggaggacgaugcggguuucuuucuaccuuuuccgcagacgacucgcccga

SEQ ID NO: 11306 - RNA, 52 nt, Artificial Sequence
  Description of Artificial Sequence: Synthetic oligonucleotide
gggaggacgaugcggcuucuugcuuuuuuucccccgcagacgacucgcccga

SEQ ID NO: 11307 - RNA, 51 nt, Artificial Sequence
  Description of Artificial Sequence: Synthetic oligonucleotide
gggaggacgaugcgguauuuuucuuacuuuccccgcagacgacucgcccga

SEQ ID NO: 11308 - RNA, 51 nt, Artificial Sequence
  Description of Artificial Sequence: Synthetic oligonucleotide
gggaggacgaugcgguuucuauuuucuuuuuuccccagacgacucgcccga

SEQ ID NO: 11309 - RNA, 51 nt, Artificial Sequence
  Description of Artificial Sequence: Synthetic oligonucleotide
gggaggacgaugcgguccagucgucuguucguccccagacgacucgcccga

SEQ ID NO: 11310 - RNA, 50 nt, Artificial Sequence
  Description of Artificial Sequence: Synthetic oligonucleotide
gggaggacgaugcgguccugucguuguucguccccagacgacucgcccga

SEQ ID NO: 11311 - RNA, 51 nt, Artificial Sequence
  Description of Artificial Sequence: Synthetic oligonucleotide
gggaggacgaugcgguaauucuuccuuuuucuccgcagacgacucgcccga

SEQ ID NO: 11312 - RNA, 51 nt, Artificial Sequence
  Description of Artificial Sequence: Synthetic oligonucleotide
gggaggacgaugcggccuuuauauuaccuucuccgcagacgacucgcccga

SEQ ID NO: 11313 - RNA, 51 nt, Artificial Sequence
  Description of Artificial Sequence: Synthetic oligonucleotide
gggaggacgaugcggucacuuuauauuucuuuccgcagacgacucgcccga

SEQ ID NO: 11314 - RNA, 51 nt, Artificial Sequence
  Description of Artificial Sequence: Synthetic oligonucleotide
gggaggacgaugcgguuuuuauuaucucugcuccgcagacgacucgcccga

SEQ ID NO: 11315 - RNA, 51 nt, Artificial Sequence
  Description of Artificial Sequence: Synthetic oligonucleotide
gggaggacgaugcgguauuuaucuuucuuuccccgcagacgacucgcccga

SEQ ID NO: 11316 - RNA, 51 nt, Artificial Sequence
  Description of Artificial Sequence: Synthetic oligonucleotide
gggaggacgaugcgguucuuuucacacuuuauccgcagacgacucgcccga

SEQ ID NO: 11317 - RNA, 51 nt, Artificial Sequence
  Description of Artificial Sequence: Synthetic oligonucleotide
gggaggacgaugcggucucuuuuguauucuucccgcagacgacucgcccga

SEQ ID NO: 11318 - RNA, 51 nt, Artificial Sequence
  Description of Artificial Sequence: Synthetic oligonucleotide
gggaggacgaugcgguuucuucuauuuuucuuccgcagacgacucgcccga

SEQ ID NO: 11319 - RNA, 51 nt, Artificial Sequence
  Description of Artificial Sequence: Synthetic oligonucleotide
gggaggacgaugcgguuuuuacuuuuauuugcccgcagacgacucgcccga

SEQ ID NO: 11320 - RNA, 51 nt, Artificial Sequence
  Description of Artificial Sequence: Synthetic oligonucleotide
gggaggacgaugcgguuuagcuuuuuuucccuccgcagacgacucgcccga

SEQ ID NO: 11321 - RNA, 51 nt, Artificial Sequence
  Description of Artificial Sequence: Synthetic oligonucleotide
gggaggacgaugcggucuuauuccuucucuuuccgcagacgacucgcccga

SEQ ID NO: 11322 - RNA, 51 nt, Artificial Sequence
  Description of Artificial Sequence: Synthetic oligonucleotide
gggaggacgaugcggacuuuauugccuuuucaccgcagacgacucgcccga

SEQ ID NO: 11323 - RNA, 51 nt, Artificial Sequence
  Description of Artificial Sequence: Synthetic oligonucleotide
gggaggacgaugcggucauuuuaucuuuuucccgccagacgacucgcccga

SEQ ID NO: 11324 - RNA, 51 nt, Artificial Sequence
  Description of Artificial Sequence: Synthetic oligonucleotide
gggaggacgaugcgguguuuucauuucucuuuccgcagacgacucgcccga

SEQ ID NO: 11325 - RNA, 51 nt, Artificial Sequence
  Description of Artificial Sequence: Synthetic oligonucleotide
gggaggacgaugcgguuucuuucauuuuucuaccgcagacgacucgcccga

SEQ ID NO: 11326 - RNA, 51 nt, Artificial Sequence
  Description of Artificial Sequence: Synthetic oligonucleotide
gggaggacgaugcggaucuuuucagcuuuuuaccgcagacgacucgcccga

SEQ ID NO: 11327 - RNA, 51 nt, Artificial Sequence
  Description of Artificial Sequence: Synthetic oligonucleotide
gggaggacgaugcggacuuucuuuccuuuauucugcagacgacucgcccga

SEQ ID NO: 11328 - RNA, 51 nt, Artificial Sequence
  Description of Artificial Sequence: Synthetic oligonucleotide
gggaggacgaugcgguucuuacguuucccuuuccgcagacgacucgcccga

SEQ ID NO: 11329 - RNA, 51 nt, Artificial Sequence
  Description of Artificial Sequence: Synthetic oligonucleotide
gggaggacgaugcggcucauuuccuuucuuuuccgcagacgacucgcccga

SEQ ID NO: 11330 - RNA, 51 nt, Artificial Sequence
  Description of Artificial Sequence: Synthetic oligonucleotide
gggaggacgaugcggccauuucuuuucuccuaccgcagacgacucgcccga

SEQ ID NO: 11331 - RNA, 51 nt, Artificial Sequence
  Description of Artificial Sequence: Synthetic oligonucleotide
gggaggacgaugcgguuucuugauuuucccuugugcagacgacucgcccga

SEQ ID NO: 11332 - RNA, 51 nt, Artificial Sequence
  Description of Artificial Sequence: Synthetic oligonucleotide
gggaggacgaugcggguuuacuuuacuuuccaccgcagacgacucgcccga

SEQ ID NO: 11333 - RNA, 51 nt, Artificial Sequence
  Description of Artificial Sequence: Synthetic oligonucleotide
gggaggacgaugcggacauucucuuuuuuucaccgcagacgacucgcccga

SEQ ID NO: 11334 - RNA, 51 nt, Artificial Sequence
  Description of Artificial Sequence: Synthetic oligonucleotide
gggaggacgaugcgguuacuuuguuuuuuucuccgcagacgacucgcccga

SEQ ID NO: 11335 - RNA, 51 nt, Artificial Sequence
  Description of Artificial Sequence: Synthetic oligonucleotide
gggaggacgaugcgguuuguuauuauuuguuuccccagacgacucgcccga

SEQ ID NO: 11336 - RNA, 51 nt, Artificial Sequence
  Description of Artificial Sequence: Synthetic oligonucleotide
gggaggacgaugcgguuugggagcaggguguuccgcagacgacucgcccga

SEQ ID NO: 11337 - RNA, 50 nt, Artificial Sequence
  Description of Artificial Sequence: Synthetic oligonucleotide
gggaggacgaugcgguucuuuauuuuucccuccgcagacgacucgcccga

SEQ ID NO: 11338 - RNA, 51 nt, Artificial Sequence
  Description of Artificial Sequence: Synthetic oligonucleotide
gggaggacgaugcggauuucuacuuucucuuuccccagacgacucgcccga

SEQ ID NO: 11339 - RNA, 51 nt, Artificial Sequence
  Description of Artificial Sequence: Synthetic oligonucleotide
gggaggacgaugcggacuuuuugcuguuuuuuccccagacgacucgcccga

SEQ ID NO: 11340 - RNA, 51 nt, Artificial Sequence
  Description of Artificial Sequence: Synthetic oligonucleotide
gggaggacgaugcgguuuuauucuuucuuuuugugcagacgacucgcccga

SEQ ID NO: 11341 - RNA, 51 nt, Artificial Sequence
  Description of Artificial Sequence: Synthetic oligonucleotide
gggaggacgaugcggucucauucucuucuucuccgcagacgacucgcccga

SEQ ID NO: 11342 - RNA, 51 nt, Artificial Sequence
  Description of Artificial Sequence: Synthetic oligonucleotide
gggaggacgaugcggccuuuucuucucauucuccgcagacgacucgcccga

SEQ ID NO: 11343 - RNA, 51 nt, Artificial Sequence
  Description of Artificial Sequence: Synthetic oligonucleotide
gggaggacgaugcgguuucauuuucucuacuuccgcagacgacucgcccga

SEQ ID NO: 11344 - RNA, 51 nt, Artificial Sequence
  Description of Artificial Sequence: Synthetic oligonucleotide
gggaggacgaugcggucucuuuacuuccucuuccgcagacgacucgcccga

SEQ ID NO: 11345 - RNA, 51 nt, Artificial Sequence
  Description of Artificial Sequence: Synthetic oligonucleotide
gggaggacgaugcggauuucucuuuuuucgucccgcagacgacucgcccga

SEQ ID NO: 11346 - RNA, 51 nt, Artificial Sequence
  Description of Artificial Sequence: Synthetic oligonucleotide
gggaggacgaugcggauucuuuaauccuuuucccgcagacgacucgcccga

SEQ ID NO: 11347 - RNA, 51 nt, Artificial Sequence
  Description of Artificial Sequence: Synthetic oligonucleotide
gggaggacgaugcgguuauugauuuuguuuugcgccagacgacucgcccga

SEQ ID NO: 11348 - RNA, 51 nt, Artificial Sequence
  Description of Artificial Sequence: Synthetic oligonucleotide
gggaggacgaugcggcuucaucuuuuuucuuaccgcagacgacucgcccga

SEQ ID NO: 11349 - RNA, 51 nt, Artificial Sequence
  Description of Artificial Sequence: Synthetic oligonucleotide
gggaggacgaugcggauuucucuauccuuuuuccccagacgacucgcccga

SEQ ID NO: 11350 - RNA, 51 nt, Artificial Sequence
  Description of Artificial Sequence: Synthetic oligonucleotide
gggaggacgaugcgguuugcucucuauuuuuuccgcagacgacucgcccga

SEQ ID NO: 11351 - RNA, 51 nt, Artificial Sequence
  Description of Artificial Sequence: Synthetic oligonucleotide
gggaggacgaugcgguuuucucugauuacuuuccgcagacgacucgcccga

SEQ ID NO: 11352 - RNA, 51 nt, Artificial Sequence
  Description of Artificial Sequence: Synthetic oligonucleotide
gggaggacgaugcggcuuauuaucuccacuuuccgcagacgacucgcccga

SEQ ID NO: 11353 - RNA, 51 nt, Artificial Sequence
  Description of Artificial Sequence: Synthetic oligonucleotide
gggaggacgaugcgguuuuacuacuuuuuugcccgcagacgacucgcccga

SEQ ID NO: 11354 - RNA, 51 nt, Artificial Sequence
  Description of Artificial Sequence: Synthetic oligonucleotide
gggaggacgaugcggguuuuucuuuucuuuuuccgcagacgacucgcccga

SEQ ID NO: 11355 - RNA, 51 nt, Artificial Sequence
  Description of Artificial Sequence: Synthetic oligonucleotide
gggaggacgaugcgguuuauuucuuuucaugugugcagacgacucgcccga

SEQ ID NO: 11356 - RNA, 51 nt, Artificial Sequence
  Description of Artificial Sequence: Synthetic oligonucleotide
gggaggacgaugcgguucuucucuuuucccugccgcagacgacucgcccga

SEQ ID NO: 11357 - RNA, 51 nt, Artificial Sequence
  Description of Artificial Sequence: Synthetic oligonucleotide
gggaggacgaugcggcuucuacucuuaucuuuccgcagacgacucgcccga

SEQ ID NO: 11358 - RNA, 51 nt, Artificial Sequence
  Description of Artificial Sequence: Synthetic oligonucleotide
gggaggacgaugcgguuucuuuuacguuuuuuccccagacgacucgcccga

SEQ ID NO: 11359 - RNA, 51 nt, Artificial Sequence
  Description of Artificial Sequence: Synthetic oligonucleotide
gggaggacgaugcggauuuccuuuuauuuuuaccgcagacgacucgcccga

SEQ ID NO: 11360 - RNA, 52 nt, Artificial Sequence
  Description of Artificial Sequence: Synthetic oligonucleotide
gggaggacgaugcgguacuucuuuuuuuucucuccgcagacgacucgcccga

SEQ ID NO: 11361 - RNA, 51 nt, Artificial Sequence
  Description of Artificial Sequence: Synthetic oligonucleotide
gggaggacgaugcggucuuuauggcuuuuucuccgcagacgacucgcccga

SEQ ID NO: 11362 - RNA, 51 nt, Artificial Sequence
  Description of Artificial Sequence: Synthetic oligonucleotide
gggaggacgaugcggauuuuuuauuuuugcuaccgcagacgacucgcccga

SEQ ID NO: 11363 - RNA, 52 nt, Artificial Sequence
  Description of Artificial Sequence: Synthetic oligonucleotide
gggaggacgaugcggaucuuuauuuuuuucucuccgcagacgacucgcccga

SEQ ID NO: 11364 - RNA, 51 nt, Artificial Sequence
  Description of Artificial Sequence: Synthetic oligonucleotide
gggaggacgaugcggcuuuuuuucuuuuguucccgcagacgacucgcccga

SEQ ID NO: 11365 - RNA, 51 nt, Artificial Sequence
  Description of Artificial Sequence: Synthetic oligonucleotide
gggaggacgaugcgguuacuuauuucuucucugcccagacgacucgcccga

SEQ ID NO: 11366 - RNA, 51 nt, Artificial Sequence
  Description of Artificial Sequence: Synthetic oligonucleotide
gggaggacgaugcgguuauuuucccacucuuuccgcagacgacucgcccga

SEQ ID NO: 11367 - RNA, 51 nt, Artificial Sequence
  Description of Artificial Sequence: Synthetic oligonucleotide
gggaggacgaugcgguuugggaggaggguguuccgcagacgacucgcccga

SEQ ID NO: 11368 - RNA, 51 nt, Artificial Sequence
  Description of Artificial Sequence: Synthetic oligonucleotide
gggaggacgaugcgguuucuuaccauuucuuuccgcagacgacucgcccga

SEQ ID NO: 11369 - RNA, 51 nt, Artificial Sequence
  Description of Artificial Sequence: Synthetic oligonucleotide
gggaggacgaugcgguuccauuuuuacuuuccccgcagacgacucgcccga

SEQ ID NO: 11370 - RNA, 51 nt, Artificial Sequence
  Description of Artificial Sequence: Synthetic oligonucleotide
gggaggacgaugcgguuuucacuuaucuucuuccgcagacgacucgcccga

SEQ ID NO: 11371 - RNA, 51 nt, Artificial Sequence
  Description of Artificial Sequence: Synthetic oligonucleotide
gggaggacgaugcggcuuuuucuugcuauuuuccgcagacgacucgcccga

SEQ ID NO: 11372 - RNA, 51 nt, Artificial Sequence
  Description of Artificial Sequence: Synthetic oligonucleotide
gggaggacgaugcggauuuuuuuccucuuuuaccgcagacgacucgcccga

SEQ ID NO: 11373 - RNA, 52 nt, Artificial Sequence
  Description of Artificial Sequence: Synthetic oligonucleotide
gggaggacgaugcgguuuuugucuuguuuuuuuccgcagacgacucgcccga

SEQ ID NO: 11374 - RNA, 52 nt, Artificial Sequence
  Description of Artificial Sequence: Synthetic oligonucleotide
gggaggacgaugcgguccugucgucuguucguuccccagacgacucgcccga

SEQ ID NO: 11375 - RNA, 51 nt, Artificial Sequence
  Description of Artificial Sequence: Synthetic oligonucleotide
gggaggacgaugcgguccauucuuccuuuuugccgcagacgacucgcccga

SEQ ID NO: 11376 - RNA, 52 nt, Artificial Sequence
  Description of Artificial Sequence: Synthetic oligonucleotide
gggaggacgaugcgguuuucuugcccuuuuuuuccgcagacgacucgcccga

SEQ ID NO: 11377 - RNA, 51 nt, Artificial Sequence
  Description of Artificial Sequence: Synthetic oligonucleotide
gggaggacgaugcggugcuuuuuuucuuuucgccgcagacgacucgcccga

SEQ ID NO: 11378 - RNA, 51 nt, Artificial Sequence
  Description of Artificial Sequence: Synthetic oligonucleotide
gggaggacgaugcggcucauuuccuauucucuccgcagacgacucgcccga

SEQ ID NO: 11379 - RNA, 51 nt, Artificial Sequence
  Description of Artificial Sequence: Synthetic oligonucleotide
gggaggacgaugcgguuuuuuauucaccuucuccgcagacgacucgcccga

SEQ ID NO: 11380 - RNA, 51 nt, Artificial Sequence
  Description of Artificial Sequence: Synthetic oligonucleotide
gggaggacgaugcgguuuacauuucuuuucuugcccagacgacucgcccga

SEQ ID NO: 11381 - RNA, 51 nt, Artificial Sequence
  Description of Artificial Sequence: Synthetic oligonucleotide
gggaggacgaugcggcuucuuugacuuucuuuccgcagacgacucgcccga

SEQ ID NO: 11382 - RNA, 52 nt, Artificial Sequence
  Description of Artificial Sequence: Synthetic oligonucleotide
gggaggacgaugcgguuuuuuuaugguuuguuuccgcagacgacucgcccga

SEQ ID NO: 11383 - RNA, 51 nt, Artificial Sequence
  Description of Artificial Sequence: Synthetic oligonucleotide
gggaggacgaugcgguuuuuguugguguuuuuccgcagacgacucgcccga

SEQ ID NO: 11384 - RNA, 53 nt, Artificial Sequence
  Description of Artificial Sequence: Synthetic oligonucleotide
gggaggacgaugcggcuuuauuuuuguuuuuuugccccagacgacucgcccga

SEQ ID NO: 11385 - RNA, 51 nt, Artificial Sequence
  Description of Artificial Sequence: Synthetic oligonucleotide
gggaggacgaugcgguucacuuuauuacuuuuccccagacgacucgcccga

SEQ ID NO: 11386 - RNA, 51 nt, Artificial Sequence
  Description of Artificial Sequence: Synthetic oligonucleotide
gggaggacgaugcggcuucacucaauuucucuccgcagacgacucgcccga

SEQ ID NO: 11387 - RNA, 52 nt, Artificial Sequence
  Description of Artificial Sequence: Synthetic oligonucleotide
gggaggacgaugcgguuuugggaguaggguguuccgcagacgacucgcccga

SEQ ID NO: 11388 - RNA, 51 nt, Artificial Sequence
  Description of Artificial Sequence: Synthetic oligonucleotide
gggaggacgaugcggcuucuuuuaccucucuuccgcagacgacucgcccga

SEQ ID NO: 11389 - RNA, 51 nt, Artificial Sequence
  Description of Artificial Sequence: Synthetic oligonucleotide
gggaggacgaugcggcuuuuuccuuuucuacuccgcagacgacucgcccga

SEQ ID NO: 11390 - RNA, 51 nt, Artificial Sequence
  Description of Artificial Sequence: Synthetic oligonucleotide
gggaggacgaugcgguuucucuucuuuucuucccgcagacgacucgcccga

SEQ ID NO: 11391 - RNA, 51 nt, Artificial Sequence
  Description of Artificial Sequence: Synthetic oligonucleotide
gggaggacgaugcggacuuucauauuuuuucaccgcagacgacucgcccga

SEQ ID NO: 11392 - RNA, 51 nt, Artificial Sequence
  Description of Artificial Sequence: Synthetic oligonucleotide
gggaggacgaugcgguuuuugaacacuuuuuucugcagacgacucgcccga

SEQ ID NO: 11393 - RNA, 51 nt, Artificial Sequence
  Description of Artificial Sequence: Synthetic oligonucleotide
gggaggacgaugcgguuugggagugggguguuccgcagacgacucgcccga

SEQ ID NO: 11394 - RNA, 51 nt, Artificial Sequence
  Description of Artificial Sequence: Synthetic oligonucleotide
gggaggacgaugcggaucuuucuuuuauccugccgcagacgacucgcccga

SEQ ID NO: 11395 - RNA, 51 nt, Artificial Sequence
  Description of Artificial Sequence: Synthetic oligonucleotide
gggaggacgaugcggcacuuuucuucaccuuuccgcagacgacucgcccga

SEQ ID NO: 11396 - RNA, 51 nt, Artificial Sequence
  Description of Artificial Sequence: Synthetic oligonucleotide
gggaggacgaugcgguuuucgcugcuuuuuccccgcagacgacucgcccga

SEQ ID NO: 11397 - RNA, 51 nt, Artificial Sequence
  Description of Artificial Sequence: Synthetic oligonucleotide
gggaggacgaugcggauaguuuuguuuuuucgccgcagacgacucgcccga

SEQ ID NO: 11398 - RNA, 51 nt, Artificial Sequence
  Description of Artificial Sequence: Synthetic oligonucleotide
gggaggacgaugcgguuuuuguugauuuguuugcccagacgacucgcccga

SEQ ID NO: 11399 - RNA, 51 nt, Artificial Sequence
  Description of Artificial Sequence: Synthetic oligonucleotide
gggaggacgaugcggcuuucucuugcucuuuuccgcagacgacucgcccga

SEQ ID NO: 11400 - RNA, 51 nt, Artificial Sequence
  Description of Artificial Sequence: Synthetic oligonucleotide
gggaggacgaugcggucuuuucuucuuauuuuccgcagacgacucgcccga

SEQ ID NO: 11401 - RNA, 53 nt, Artificial Sequence
  Description of Artificial Sequence: Synthetic oligonucleotide
gggaggacgaugcggaauuauguguuuuuuuugaccgcagacgacucgcccga

SEQ ID NO: 11402 - RNA, 51 nt, Artificial Sequence
  Description of Artificial Sequence: Synthetic oligonucleotide
gggaggacgaugcgguuuucucuuuaaucuugccgcagacgacucgcccga

SEQ ID NO: 11403 - RNA, 51 nt, Artificial Sequence
  Description of Artificial Sequence: Synthetic oligonucleotide
gggaggacgaugcgguuuuauuucacuuuuacccgcagacgacucgcccga

SEQ ID NO: 11404 - RNA, 51 nt, Artificial Sequence
  Description of Artificial Sequence: Synthetic oligonucleotide
gggaggacgaugcgguuuuuccauuuucucauccgcagacgacucgcccga

SEQ ID NO: 11405 - RNA, 51 nt, Artificial Sequence
  Description of Artificial Sequence: Synthetic oligonucleotide
gggaggacgaugcggaucuugcucuuuauuugccgcagacgacucgcccga

SEQ ID NO: 11406 - RNA, 51 nt, Artificial Sequence
  Description of Artificial Sequence: Synthetic oligonucleotide
gggaggacgaugcgguucuuacuuuucaccuuccgcagacgacucgcccga

SEQ ID NO: 11407 - RNA, 51 nt, Artificial Sequence
  Description of Artificial Sequence: Synthetic oligonucleotide
gggaggacgaugcgguuuuuucuaucuuccguccgcagacgacucgcccga

SEQ ID NO: 11408 - RNA, 51 nt, Artificial Sequence
  Description of Artificial Sequence: Synthetic oligonucleotide
gggaggacgaugcggcuuuacuguuuccuuuuccgcagacgacucgcccga

SEQ ID NO: 11409 - RNA, 51 nt, Artificial Sequence
  Description of Artificial Sequence: Synthetic oligonucleotide
gggaggacgaugcggucuuucuuuaacuuuuuccgcagacgacucgcccga

SEQ ID NO: 11410 - RNA, 51 nt, Artificial Sequence
  Description of Artificial Sequence: Synthetic oligonucleotide
gggaggacgaugcggccuuuucauuucucuuaccgcagacgacucgcccga

SEQ ID NO: 11411 - RNA, 51 nt, Artificial Sequence
  Description of Artificial Sequence: Synthetic oligonucleotide
gggaggacgaugcggaucucuuguuauuuuucccgcagacgacucgcccga

SEQ ID NO: 11412 - RNA, 52 nt, Artificial Sequence
  Description of Artificial Sequence: Synthetic oligonucleotide
gggaggacgaugcgguuuguuuuuucucuuuuuccgcagacgacucgcccga

SEQ ID NO: 11413 - RNA, 51 nt, Artificial Sequence
  Description of Artificial Sequence: Synthetic oligonucleotide
gggaggacgaugcgguucuuuguuuuuuucucccgcagacgacucgcccga

SEQ ID NO: 11414 - RNA, 51 nt, Artificial Sequence
  Description of Artificial Sequence: Synthetic oligonucleotide
gggaggacgaugcgguuuucuucacuuuuuucccgcagacgacucgcccga

SEQ ID NO: 11415 - RNA, 51 nt, Artificial Sequence
  Description of Artificial Sequence: Synthetic oligonucleotide
gggaggacgaugcgguuuuauccucguuuucuccgcagacgacucgcccga

SEQ ID NO: 11416 - RNA, 52 nt, Artificial Sequence
  Description of Artificial Sequence: Synthetic oligonucleotide
gggaggacgaugcgguuucacucuuuuuuuccccgccagacgacucgcccga

SEQ ID NO: 11417 - RNA, 51 nt, Artificial Sequence
  Description of Artificial Sequence: Synthetic oligonucleotide
gggaggacgaugcggguuuugcuccuuuuucgccgcagacgacucgcccga

SEQ ID NO: 11418 - RNA, 51 nt, Artificial Sequence
  Description of Artificial Sequence: Synthetic oligonucleotide
gggaggacgaugcggccuuauguuuucccuuuccgcagacgacucgcccga

SEQ ID NO: 11419 - RNA, 51 nt, Artificial Sequence
  Description of Artificial Sequence: Synthetic oligonucleotide
gggaggacgaugcggacuuuucccuaucuuuuccgcagacgacucgcccga

SEQ ID NO: 11420 - RNA, 51 nt, Artificial Sequence
  Description of Artificial Sequence: Synthetic oligonucleotide
gggaggacgaugcgguauuuuucacguuuccuccgcagacgacucgcccga

SEQ ID NO: 11421 - RNA, 51 nt, Artificial Sequence
  Description of Artificial Sequence: Synthetic oligonucleotide
gggaggacgaugcggcuuuuccuauuucuacuccgcagacgacucgcccga

SEQ ID NO: 11422 - RNA, 50 nt, Artificial Sequence
  Description of Artificial Sequence: Synthetic oligonucleotide
gggaggacgaugcgguuucuuguucuuucuuccgcagacgacucgcccga

SEQ ID NO: 11423 - RNA, 51 nt, Artificial Sequence
  Description of Artificial Sequence: Synthetic oligonucleotide
gggaggacgaugcggguucuuauuauucucuaccgcagacgacucgcccga

SEQ ID NO: 11424 - RNA, 51 nt, Artificial Sequence
  Description of Artificial Sequence: Synthetic oligonucleotide
gggaggacgaugcggauuuuugacuuuucuuaccgcagacgacucgcccga

SEQ ID NO: 11425 - RNA, 51 nt, Artificial Sequence
  Description of Artificial Sequence: Synthetic oligonucleotide
gggaggacgaugcggucuuuuucucgccuuauccgcagacgacucgcccga

SEQ ID NO: 11426 - RNA, 51 nt, Artificial Sequence
  Description of Artificial Sequence: Synthetic oligonucleotide
gggaggacgaugcggauuuuauuuauucgcuaccgcagacgacucgcccga

SEQ ID NO: 11427 - RNA, 51 nt, Artificial Sequence
  Description of Artificial Sequence: Synthetic oligonucleotide
gggaggacgaugcggaauuuucuauccuuuuaccgcagacgacucgcccga

SEQ ID NO: 11428 - RNA, 51 nt, Artificial Sequence
  Description of Artificial Sequence: Synthetic oligonucleotide
gggaggacgaugcggucuuuuuuuuguuucccccgcagacgacucgcccga

SEQ ID NO: 11429 - RNA, 51 nt, Artificial Sequence
  Description of Artificial Sequence: Synthetic oligonucleotide
gggaggacgaugcggcuucauacuuuuuucuuccgcagacgacucgcccga

SEQ ID NO: 11430 - RNA, 51 nt, Artificial Sequence
  Description of Artificial Sequence: Synthetic oligonucleotide
gggaggacgaugcgguuuuuuaauguuuuuuuccgcagacgacucgcccga

SEQ ID NO: 11431 - RNA, 51 nt, Artificial Sequence
  Description of Artificial Sequence: Synthetic oligonucleotide
gggaggacgaugcgguugugcguuuuuuuuugccgcagacgacucgcccga

SEQ ID NO: 11432 - RNA, 51 nt, Artificial Sequence
  Description of Artificial Sequence: Synthetic oligonucleotide
gggaggacgaugcgguuguuguuuuauugguuccgcagacgacucgcccga

SEQ ID NO: 11433 - RNA, 51 nt, Artificial Sequence
  Description of Artificial Sequence: Synthetic oligonucleotide
gggaggacgaugcggauuuguuuaauuuuguuccccagacgacucgcccga

SEQ ID NO: 11434 - RNA, 51 nt, Artificial Sequence
  Description of Artificial Sequence: Synthetic oligonucleotide
gggaggacgaugcgguuacuuauuuauuugcuccgcagacgacucgcccga

SEQ ID NO: 11435 - RNA, 51 nt, Artificial Sequence
  Description of Artificial Sequence: Synthetic oligonucleotide
gggaggacgaugcggucuguuacacuuuuuuuccgcagacgacucgcccga

SEQ ID NO: 11436 - RNA, 51 nt, Artificial Sequence
  Description of Artificial Sequence: Synthetic oligonucleotide
gggaggacgaugcggcuucuauuuuucgcuuaccgcagacgacucgcccga

SEQ ID NO: 11437 - RNA, 51 nt, Artificial Sequence
  Description of Artificial Sequence: Synthetic oligonucleotide
gggaggacgaugcggauuuccuuguuuuuguugugcagacgacucgcccga

SEQ ID NO: 11438 - RNA, 51 nt, Artificial Sequence
  Description of Artificial Sequence: Synthetic oligonucleotide
gggaggacgaugcgguuucuuucauuuuuuuuccgcagacgacucgcccga

SEQ ID NO: 11439 - RNA, 51 nt, Artificial Sequence
  Description of Artificial Sequence: Synthetic oligonucleotide
gggaggacgaugcggcuuuucuaucuuuucuuccgcagacgacucgcccga

SEQ ID NO: 11440 - RNA, 51 nt, Artificial Sequence
  Description of Artificial Sequence: Synthetic oligonucleotide
gggaggacgaugcgguauucucuugcuuugcuccgcagacgacucgcccga

SEQ ID NO: 11441 - RNA, 51 nt, Artificial Sequence
  Description of Artificial Sequence: Synthetic oligonucleotide
gggaggacgaugcggucugggaguaggguguuccgcagacgacucgcccga

SEQ ID NO: 11442 - RNA, 51 nt, Artificial Sequence
  Description of Artificial Sequence: Synthetic oligonucleotide
gggaggacgaugcggauuagguguaggguggacugcagacgacucgcccga

SEQ ID NO: 11443 - RNA, 51 nt, Artificial Sequence
  Description of Artificial Sequence: Synthetic oligonucleotide
gggaggacgaugcggauuaucguuuucuuucaccgcagacgacucgcccga

SEQ ID NO: 11444 - RNA, 51 nt, Artificial Sequence
  Description of Artificial Sequence: Synthetic oligonucleotide
gggaggacgaugcggcuuuuuuucuccuuuugcugcagacgacucgcccga

SEQ ID NO: 11445 - RNA, 51 nt, Artificial Sequence
  Description of Artificial Sequence: Synthetic oligonucleotide
gggaggacgaugcggucaucuuugucuuuuuuccgcagacgacucgcccga

SEQ ID NO: 11446 - RNA, 51 nt, Artificial Sequence
  Description of Artificial Sequence: Synthetic oligonucleotide
gggaggacgaugcggguuuuuguugguuuuuuccgcagacgacucgcccga

SEQ ID NO: 11447 - RNA, 51 nt, Artificial Sequence
  Description of Artificial Sequence: Synthetic oligonucleotide
gggaggacgaugcgguuuauuucucacuuuuugcgcagacgacucgcccga

SEQ ID NO: 11448 - RNA, 51 nt, Artificial Sequence
  Description of Artificial Sequence: Synthetic oligonucleotide
gggaggacgaugcggauuuugcuuuuuuacuaccgcagacgacucgcccga

SEQ ID NO: 11449 - RNA, 51 nt, Artificial Sequence
  Description of Artificial Sequence: Synthetic oligonucleotide
gggaggacgaugcggauuuuacuguucucuuuccccagacgacucgcccga

SEQ ID NO: 11450 - RNA, 51 nt, Artificial Sequence
  Description of Artificial Sequence: Synthetic oligonucleotide
gggaggacgaugcggauuuuccauggcuuuuaccgcagacgacucgcccga

SEQ ID NO: 11451 - RNA, 53 nt, Artificial Sequence
  Description of Artificial Sequence: Synthetic oligonucleotide
gggaggacgaugcgguuuuuacccuuuuuuuuguccgcagacgacucgcccga

SEQ ID NO: 11452 - RNA, 51 nt, Artificial Sequence
  Description of Artificial Sequence: Synthetic oligonucleotide
gggaggacgaugcggaucaucacuuucuuuuaccgcagacgacucgcccga

SEQ ID NO: 11453 - RNA, 51 nt, Artificial Sequence
  Description of Artificial Sequence: Synthetic oligonucleotide
gggaggacgaugcgguuguuucuuuauuuuucccgcagacgacucgcccga

SEQ ID NO: 11454 - RNA, 51 nt, Artificial Sequence
  Description of Artificial Sequence: Synthetic oligonucleotide
gggaggacgaugcggucuuuuuaacguuuccuccgcagacgacucgcccga

SEQ ID NO: 11455 - RNA, 51 nt, Artificial Sequence
  Description of Artificial Sequence: Synthetic oligonucleotide
gggaggacgaugcgguuuucacuuuuuuucggcugcagacgacucgcccga

SEQ ID NO: 11456 - RNA, 51 nt, Artificial Sequence
  Description of Artificial Sequence: Synthetic oligonucleotide
gggaggacgaugcgguucuuuuugucaucucuccgcagacgacucgcccga

SEQ ID NO: 11457 - RNA, 51 nt, Artificial Sequence
  Description of Artificial Sequence: Synthetic oligonucleotide
gggaggacgaugcgguuucucaacuaucuuuuccgcagacgacucgcccga

SEQ ID NO: 11458 - RNA, 51 nt, Artificial Sequence
  Description of Artificial Sequence: Synthetic oligonucleotide
gggaggacgaugcgguucuuuguuuuauuauuccgcagacgacucgcccga

SEQ ID NO: 11459 - RNA, 51 nt, Artificial Sequence
  Description of Artificial Sequence: Synthetic oligonucleotide
gggaggacgaugcgguguuuuauuuguuuugcgugcagacgacucgcccga

SEQ ID NO: 11460 - RNA, 51 nt, Artificial Sequence
  Description of Artificial Sequence: Synthetic oligonucleotide
gggaggacgaugcgguuugggaguagggaguuccgcagacgacucgcccga

SEQ ID NO: 11461 - RNA, 51 nt, Artificial Sequence
  Description of Artificial Sequence: Synthetic oligonucleotide
gggaggacgaugcgguuugggagaaggguguuccgcagacgacucgcccga

SEQ ID NO: 11462 - RNA, 51 nt, Artificial Sequence
  Description of Artificial Sequence: Synthetic oligonucleotide
gggaggacgaugcggugcuuuauuuuuccuucccgcagacgacucgcccga

SEQ ID NO: 11463 - RNA, 50 nt, Artificial Sequence
  Description of Artificial Sequence: Synthetic oligonucleotide
gggaggacgaugcgguuuguuuuauuuuuguccccagacgacucgcccga

SEQ ID NO: 11464 - RNA, 51 nt, Artificial Sequence
  Description of Artificial Sequence: Synthetic oligonucleotide
gggaggacgaugcggcuuuucacuuuuuucuuccgcagacgacucgcccga

SEQ ID NO: 11465 - RNA, 51 nt, Artificial Sequence
  Description of Artificial Sequence: Synthetic oligonucleotide
gggaggacgaugcgguuuuaucuuuuguuuuugcgcagacgacucgcccga

SEQ ID NO: 11466 - RNA, 51 nt, Artificial Sequence
  Description of Artificial Sequence: Synthetic oligonucleotide
gggaggacgaugcggcgauuccucuggcucguccccagacgacucgcccga

SEQ ID NO: 11467 - RNA, 51 nt, Artificial Sequence
  Description of Artificial Sequence: Synthetic oligonucleotide
gggaggacgaugcgguaucuucucuuucucauccgcagacgacucgcccga

SEQ ID NO: 11468 - RNA, 51 nt, Artificial Sequence
  Description of Artificial Sequence: Synthetic oligonucleotide
gggaggacgaugcgguuuccuuuuaacuugcuccgcagacgacucgcccga

SEQ ID NO: 11469 - RNA, 51 nt, Artificial Sequence
  Description of Artificial Sequence: Synthetic oligonucleotide
gggaggacgaugcggauuuugguuauuuuuggccgcagacgacucgcccga

SEQ ID NO: 11470 - RNA, 53 nt, Artificial Sequence
  Description of Artificial Sequence: Synthetic oligonucleotide
gggaggacgaugcggauucucuuuuuuuuucccaccgcagacgacucgcccga

SEQ ID NO: 11471 - RNA, 51 nt, Artificial Sequence
  Description of Artificial Sequence: Synthetic oligonucleotide
gggaggacgaugcggguuuugucuuuuuccuuccgcagacgacucgcccga

SEQ ID NO: 11472 - RNA, 51 nt, Artificial Sequence
  Description of Artificial Sequence: Synthetic oligonucleotide
gggaggacgaugcgguucacuuuuuucucuugcugcagacgacucgcccga

SEQ ID NO: 11473 - RNA, 51 nt, Artificial Sequence
  Description of Artificial Sequence: Synthetic oligonucleotide
gggaggacgaugcgguauugcucuuuuauuuuccccagacgacucgcccga

SEQ ID NO: 11474 - RNA, 51 nt, Artificial Sequence
  Description of Artificial Sequence: Synthetic oligonucleotide
gggaggacgaugcgguuccacuuuuuuuuucuccgcagacgacucgcccga

SEQ ID NO: 11475 - RNA, 51 nt, Artificial Sequence
  Description of Artificial Sequence: Synthetic oligonucleotide
gggaggacgaugcgguuuuuguaauguuuuuuccccagacgacucgcccga

SEQ ID NO: 11476 - RNA, 51 nt, Artificial Sequence
  Description of Artificial Sequence: Synthetic oligonucleotide
gggaggacgaugcgguuuauuuucacuuuuucccgcagacgacucgcccga

SEQ ID NO: 11477 - RNA, 51 nt, Artificial Sequence
  Description of Artificial Sequence: Synthetic oligonucleotide
gggaggacgaugcggauauuauuuuguuuuuugcccagacgacucgcccga

SEQ ID NO: 11478 - RNA, 51 nt, Artificial Sequence
  Description of Artificial Sequence: Synthetic oligonucleotide
gggaggacgaugcgguuuucuuacgcguuuuuccgcagacgacucgcccga

SEQ ID NO: 11479 - RNA, 51 nt, Artificial Sequence
  Description of Artificial Sequence: Synthetic oligonucleotide
gggaggacgaugcggucacuuucuauucccuuccgcagacgacucgcccga

SEQ ID NO: 11480 - RNA, 51 nt, Artificial Sequence
  Description of Artificial Sequence: Synthetic oligonucleotide
gggaggacgaugcgggauagaggagguggugccugcagacgacucgcccga

SEQ ID NO: 11481 - RNA, 51 nt, Artificial Sequence
  Description of Artificial Sequence: Synthetic oligonucleotide
gggaggacgaugcgguuucucagucuucuuuuccgcagacgacucgcccga

SEQ ID NO: 11482 - RNA, 51 nt, Artificial Sequence
  Description of Artificial Sequence: Synthetic oligonucleotide
gggaggacgaugcggcauuuuccuaguuuucuccgcagacgacucgcccga

SEQ ID NO: 11483 - RNA, 52 nt, Artificial Sequence
  Description of Artificial Sequence: Synthetic oligonucleotide
gggaggacgaugcgguccugucgucuguuccguccccagacgacucgcccga

SEQ ID NO: 11484 - RNA, 53 nt, Artificial Sequence
  Description of Artificial Sequence: Synthetic oligonucleotide
gggaggacgaugcggaauuauguguuuuuugugaccucagacgacucgcccga

SEQ ID NO: 11485 - RNA, 51 nt, Artificial Sequence
  Description of Artificial Sequence: Synthetic oligonucleotide
gggaggacgaugcggucauuauuucuucuccuccgcagacgacucgcccga

SEQ ID NO: 11486 - RNA, 51 nt, Artificial Sequence
  Description of Artificial Sequence: Synthetic oligonucleotide
gggaggacgaugcggccuuuauuauacucucuccgcagacgacucgcccga

SEQ ID NO: 11487 - RNA, 51 nt, Artificial Sequence
  Description of Artificial Sequence: Synthetic oligonucleotide
gggaggacgaugcggacuacucggcauuggugccccagacgacucgcccga

SEQ ID NO: 11488 - RNA, 51 nt, Artificial Sequence
  Description of Artificial Sequence: Synthetic oligonucleotide
gggaggacgaugcgguuucgcuacacuuuuuuccgcagacgacucgcccga

SEQ ID NO: 11489 - RNA, 52 nt, Artificial Sequence
  Description of Artificial Sequence: Synthetic oligonucleotide
gggaggacgaugcggucuuuuuuuuguguuucuccgcagacgacucgcccga

SEQ ID NO: 11490 - RNA, 52 nt, Artificial Sequence
  Description of Artificial Sequence: Synthetic oligonucleotide
gggaggacgaugcggcuauccuuguuuuuucuuccgcagacgacucgcccga

SEQ ID NO: 11491 - RNA, 51 nt, Artificial Sequence
  Description of Artificial Sequence: Synthetic oligonucleotide
gggaggacgaugcgguuuacuuuucuaucuuuccgcagacgacucgcccga

SEQ ID NO: 11492 - RNA, 51 nt, Artificial Sequence
  Description of Artificial Sequence: Synthetic oligonucleotide
gggaggacgaugcgggauuuuucgcuguuuuaccccagacgacucgcccga

SEQ ID NO: 11493 - RNA, 49 nt, Artificial Sequence
  Description of Artificial Sequence: Synthetic oligonucleotide
gggaggacgaugcgguuuguuuuuuuguuucugcagacgacucgcccga

SEQ ID NO: 11494 - RNA, 51 nt, Artificial Sequence
  Description of Artificial Sequence: Synthetic oligonucleotide
gggaggacgaugcgguuucaacuuuuucauuuccccagacgacucgcccga

SEQ ID NO: 11495 - RNA, 51 nt, Artificial Sequence
  Description of Artificial Sequence: Synthetic oligonucleotide
gggaggacgaugcgguuucauuuauucuuucugugcagacgacucgcccga

SEQ ID NO: 11496 - RNA, 51 nt, Artificial Sequence
  Description of Artificial Sequence: Synthetic oligonucleotide
gggaggacgaugcggcauaggaguagggugguggccagacgacucgcccga

SEQ ID NO: 11497 - RNA, 51 nt, Artificial Sequence
  Description of Artificial Sequence: Synthetic oligonucleotide
gggaggacgaugcggcuuuucuauuucuccuuccgcagacgacucgcccga

SEQ ID NO: 11498 - RNA, 51 nt, Artificial Sequence
  Description of Artificial Sequence: Synthetic oligonucleotide
gggaggacgaugcggguuucuucuucuuauuuccgcagacgacucgcccga

SEQ ID NO: 11499 - RNA, 51 nt, Artificial Sequence
  Description of Artificial Sequence: Synthetic oligonucleotide
gggaggacgaugcggcuuuacuuuuuaucucaccgcagacgacucgcccga

SEQ ID NO: 11500 - RNA, 51 nt, Artificial Sequence
  Description of Artificial Sequence: Synthetic oligonucleotide
gggaggacgaugcggauucuuucuuuucugucccgcagacgacucgcccga

SEQ ID NO: 11501 - RNA, 51 nt, Artificial Sequence
  Description of Artificial Sequence: Synthetic oligonucleotide
gggaggacgaugcgguuucuuuguuuguuuucgugcagacgacucgcccga

SEQ ID NO: 11502 - RNA, 51 nt, Artificial Sequence
  Description of Artificial Sequence: Synthetic oligonucleotide
gggaggacgaugcggguuuuucauuauucuuuccccagacgacucgcccga

SEQ ID NO: 11503 - RNA, 50 nt, Artificial Sequence
  Description of Artificial Sequence: Synthetic oligonucleotide
gggaggacgaugcgguccugucucuguucguccccagacgacucgcccga

SEQ ID NO: 11504 - RNA, 51 nt, Artificial Sequence
  Description of Artificial Sequence: Synthetic oligonucleotide
gggaggacgaugcggauuacucuucucucuugccgcagacgacucgcccga

SEQ ID NO: 11505 - RNA, 51 nt, Artificial Sequence
  Description of Artificial Sequence: Synthetic oligonucleotide
gggaggacgaugcggcgcuuuuuguuuuuccucgccagacgacucgcccga

SEQ ID NO: 11506 - RNA, 51 nt, Artificial Sequence
  Description of Artificial Sequence: Synthetic oligonucleotide
gggaggacgaugcgggucuugucuauuuuuccccgcagacgacucgcccga

SEQ ID NO: 11507 - RNA, 51 nt, Artificial Sequence
  Description of Artificial Sequence: Synthetic oligonucleotide
gggaggacgaugcggacuuucucuucuuuuauccccagacgacucgcccga

SEQ ID NO: 11508 - RNA, 52 nt, Artificial Sequence
  Description of Artificial Sequence: Synthetic oligonucleotide
gggaggacgaugcgguuuccuuuuuuuucccauccgcagacgacucgcccga

SEQ ID NO: 11509 - RNA, 51 nt, Artificial Sequence
  Description of Artificial Sequence: Synthetic oligonucleotide
gggaggacgaugcggucuuuuauucuucuuuaccgcagacgacucgcccga

SEQ ID NO: 11510 - RNA, 51 nt, Artificial Sequence
  Description of Artificial Sequence: Synthetic oligonucleotide
gggaggacgaugcgguccugucguguguucguccccagacgacucgcccga

SEQ ID NO: 11511 - RNA, 49 nt, Artificial Sequence
  Description of Artificial Sequence: Synthetic oligonucleotide
gggaggacgaugcggauucuugcuuuuuugccgcagacgacucgcccga

SEQ ID NO: 11512 - RNA, 51 nt, Artificial Sequence
  Description of Artificial Sequence: Synthetic oligonucleotide
gggaggacgaugcggaucuuuuuacacucucaccgcagacgacucgcccga

SEQ ID NO: 11513 - RNA, 51 nt, Artificial Sequence
  Description of Artificial Sequence: Synthetic oligonucleotide
gggaggacgaugcggcuuuuuacacuuuuaucccgcagacgacucgcccga

SEQ ID NO: 11514 - RNA, 51 nt, Artificial Sequence
  Description of Artificial Sequence: Synthetic oligonucleotide
gggaggacgaugcggauuuuauuucccuuuccccgcagacgacucgcccga

SEQ ID NO: 11515 - RNA, 51 nt, Artificial Sequence
  Description of Artificial Sequence: Synthetic oligonucleotide
gggaggacgaugcgguuuuccauuuuuucacuccgcagacgacucgcccga

SEQ ID NO: 11516 - RNA, 51 nt, Artificial Sequence
  Description of Artificial Sequence: Synthetic oligonucleotide
gggaggacgaugcggcuuuuauuauuuguuuaccgcagacgacucgcccga

SEQ ID NO: 11517 - RNA, 51 nt, Artificial Sequence
  Description of Artificial Sequence: Synthetic oligonucleotide
gggaggacgaugcggucuuauuucuuucuuccccgcagacgacucgcccga

SEQ ID NO: 11518 - RNA, 51 nt, Artificial Sequence
  Description of Artificial Sequence: Synthetic oligonucleotide
gggaggacgaugcgguuucuuuguuucuuuuccugcagacgacucgcccga

SEQ ID NO: 11519 - RNA, 51 nt, Artificial Sequence
  Description of Artificial Sequence: Synthetic oligonucleotide
gggaggacgaugcgguuugggguuuucccgcgccccagacgacucgcccga

SEQ ID NO: 11520 - RNA, 51 nt, Artificial Sequence
  Description of Artificial Sequence: Synthetic oligonucleotide
gggaggacgaugcggguugggguuuucccgugccccagacgacucgcccga

SEQ ID NO: 11521 - RNA, 51 nt, Artificial Sequence
  Description of Artificial Sequence: Synthetic oligonucleotide
gggaggacgaugcggcaauugguggaggugggcugcagacgacucgcccga

SEQ ID NO: 11522 - RNA, 51 nt, Artificial Sequence
  Description of Artificial Sequence: Synthetic oligonucleotide
gggaggacgaugcggauuucucgaucuuuucuccgcagacgacucgcccga

SEQ ID NO: 11523 - RNA, 51 nt, Artificial Sequence
  Description of Artificial Sequence: Synthetic oligonucleotide
gggaggacgaugcgguuuacucucuuacuucuccgcagacgacucgcccga

SEQ ID NO: 11524 - RNA, 52 nt, Artificial Sequence
  Description of Artificial Sequence: Synthetic oligonucleotide
gggaggacgaugcgguuuuucguguuuuuugcaccgcagacgacucgcccga

SEQ ID NO: 11525 - RNA, 51 nt, Artificial Sequence
  Description of Artificial Sequence: Synthetic oligonucleotide
gggaggacgaugcgguuuguugccccuuuuuuccgcagacgacucgcccga

SEQ ID NO: 11526 - RNA, 51 nt, Artificial Sequence
  Description of Artificial Sequence: Synthetic oligonucleotide
gggaggacgaugcgguuuuaacauuaccuuuuccccagacgacucgcccga

SEQ ID NO: 11527 - RNA, 51 nt, Artificial Sequence
  Description of Artificial Sequence: Synthetic oligonucleotide
gggaggacgaugcggauuccuacuuuuuuuccccgcagacgacucgcccga

SEQ ID NO: 11528 - RNA, 51 nt, Artificial Sequence
  Description of Artificial Sequence: Synthetic oligonucleotide
gggaggacgaugcggccuuuucauuuucuauuccgcagacgacucgcccga

SEQ ID NO: 11529 - RNA, 51 nt, Artificial Sequence
  Description of Artificial Sequence: Synthetic oligonucleotide
gggaggacgaugcgguuuucacuuuuucuuuugcccagacgacucgcccga

SEQ ID NO: 11530 - RNA, 51 nt, Artificial Sequence
  Description of Artificial Sequence: Synthetic oligonucleotide
gggaggacgaugcgguuuuuucauuaucuuguccccagacgacucgcccga

SEQ ID NO: 11531 - RNA, 51 nt, Artificial Sequence
  Description of Artificial Sequence: Synthetic oligonucleotide
gggaggacgaugcggcaaagggagguguagggugccagacgacucgcccga

SEQ ID NO: 11532 - RNA, 51 nt, Artificial Sequence
  Description of Artificial Sequence: Synthetic oligonucleotide
gggaggacgaugcggguucuuagucuuucuuuccgcagacgacucgcccga

SEQ ID NO: 11533 - RNA, 52 nt, Artificial Sequence
  Description of Artificial Sequence: Synthetic oligonucleotide
gggaggacgaugcgguuuauuucuuuccacguuccucagacgacucgcccga

SEQ ID NO: 11534 - RNA, 51 nt, Artificial Sequence
  Description of Artificial Sequence: Synthetic oligonucleotide
gggaggacgaugcgguuuuacaaaauuucgcuccgcagacgacucgcccga

SEQ ID NO: 11535 - RNA, 51 nt, Artificial Sequence
  Description of Artificial Sequence: Synthetic oligonucleotide
gggaggacgaugcggucuuuacuuuuuuucacccgcagacgacucgcccga

SEQ ID NO: 11536 - RNA, 51 nt, Artificial Sequence
  Description of Artificial Sequence: Synthetic oligonucleotide
gggaggacgaugcgguuauuuuuugccugcuuccgcagacgacucgcccga

SEQ ID NO: 11537 - RNA, 51 nt, Artificial Sequence
  Description of Artificial Sequence: Synthetic oligonucleotide
gggaggacgaugcgguuuuuuauacaccuuuuccgcagacgacucgcccga

SEQ ID NO: 11538 - RNA, 52 nt, Artificial Sequence
  Description of Artificial Sequence: Synthetic oligonucleotide
gggaggacgaugcgguuuuuauuucguguuuuugcgcagacgacucgcccga

SEQ ID NO: 11539 - RNA, 51 nt, Artificial Sequence
  Description of Artificial Sequence: Synthetic oligonucleotide
gggaggacgaugcgguucuuuauuucuaucuuccgcagacgacucgcccga

SEQ ID NO: 11540 - RNA, 51 nt, Artificial Sequence
  Description of Artificial Sequence: Synthetic oligonucleotide
gggaggacgaugcgguccuuucguucuucccuccccagacgacucgcccga

SEQ ID NO: 11541 - RNA, 51 nt, Artificial Sequence
  Description of Artificial Sequence: Synthetic oligonucleotide
gggaggacgaugcgguuccauucgcuuuuucuccgcagacgacucgcccga

SEQ ID NO: 11542 - RNA, 50 nt, Artificial Sequence
  Description of Artificial Sequence: Synthetic oligonucleotide
gggaggacgaugcggcauuacuucuucuucuccgcagacgacucgcccga

SEQ ID NO: 11543 - RNA, 51 nt, Artificial Sequence
  Description of Artificial Sequence: Synthetic oligonucleotide
gggaggacgaugcgguuuucuuguuguuuuugccccagacgacucgcccga

SEQ ID NO: 11544 - RNA, 51 nt, Artificial Sequence
  Description of Artificial Sequence: Synthetic oligonucleotide
gggaggacgaugcggcuuuauuucacucuuuaccgcagacgacucgcccga

SEQ ID NO: 11545 - RNA, 51 nt, Artificial Sequence
  Description of Artificial Sequence: Synthetic oligonucleotide
gggaggacgaugcggcuucuuuguucguuuuuccgcagacgacucgcccga

SEQ ID NO: 11546 - RNA, 51 nt, Artificial Sequence
  Description of Artificial Sequence: Synthetic oligonucleotide
gggaggacgaugcgguuuucgcuuuucuuuauccgcagacgacucgcccga

SEQ ID NO: 11547 - RNA, 51 nt, Artificial Sequence
  Description of Artificial Sequence: Synthetic oligonucleotide
gggaggacgaugcggucucuuauaacuucuuuccgcagacgacucgcccga

SEQ ID NO: 11548 - RNA, 51 nt, Artificial Sequence
  Description of Artificial Sequence: Synthetic oligonucleotide
gggaggacgaugcgguuuuaucucuguuuuuugcccagacgacucgcccga

SEQ ID NO: 11549 - RNA, 51 nt, Artificial Sequence
  Description of Artificial Sequence: Synthetic oligonucleotide
gggaggacgaugcgguuuuuccauuucuuuacccgcagacgacucgcccga

SEQ ID NO: 11550 - RNA, 51 nt, Artificial Sequence
  Description of Artificial Sequence: Synthetic oligonucleotide
gggaggacgaugcgguucauuuguucuuuuucccgcagacgacucgcccga

SEQ ID NO: 11551 - RNA, 51 nt, Artificial Sequence
  Description of Artificial Sequence: Synthetic oligonucleotide
gggaggacgaugcgguuuuucgccauuuuuccccgcagacgacucgcccga

SEQ ID NO: 11552 - RNA, 52 nt, Artificial Sequence
  Description of Artificial Sequence: Synthetic oligonucleotide
gggaggacgaugcgguuccacuuuuuuuuuucuccgcagacgacucgcccga

SEQ ID NO: 11553 - RNA, 51 nt, Artificial Sequence
  Description of Artificial Sequence: Synthetic oligonucleotide
gggaggacgaugcggccuuuuucuuuuuucuaccgcagacgacucgcccga

SEQ ID NO: 11554 - RNA, 51 nt, Artificial Sequence
  Description of Artificial Sequence: Synthetic oligonucleotide
gggaggacgaugcggucuuuuuucuucuuucuccgcagacgacucgcccga

SEQ ID NO: 11555 - RNA, 51 nt, Artificial Sequence
  Description of Artificial Sequence: Synthetic oligonucleotide
gggaggacgaugcggucuuuuucuacuuuuacccgcagacgacucgcccga

SEQ ID NO: 11556 - RNA, 51 nt, Artificial Sequence
  Description of Artificial Sequence: Synthetic oligonucleotide
gggaggacgaugcggcuuuauuauuuuccuucccgcagacgacucgcccga

SEQ ID NO: 11557 - RNA, 51 nt, Artificial Sequence
  Description of Artificial Sequence: Synthetic oligonucleotide
gggaggacgaugcggguuccauuucucuuuugccgcagacgacucgcccga

SEQ ID NO: 11558 - RNA, 51 nt, Artificial Sequence
  Description of Artificial Sequence: Synthetic oligonucleotide
gggaggacgaugcgguuuuucuucuuuuaguuccgcagacgacucgcccga

SEQ ID NO: 11559 - RNA, 51 nt, Artificial Sequence
  Description of Artificial Sequence: Synthetic oligonucleotide
gggaggacgaugcgguguuuuuuucccuuuccccgcagacgacucgcccga

SEQ ID NO: 11560 - RNA, 52 nt, Artificial Sequence
  Description of Artificial Sequence: Synthetic oligonucleotide
gggaggacgaugcggguaucucuuuucuuuucuccgcagacgacucgcccga

SEQ ID NO: 11561 - RNA, 51 nt, Artificial Sequence
  Description of Artificial Sequence: Synthetic oligonucleotide
gggaggacgaugcggucuuuucauugcucuuuccgcagacgacucgcccga

SEQ ID NO: 11562 - RNA, 51 nt, Artificial Sequence
  Description of Artificial Sequence: Synthetic oligonucleotide
gggaggacgaugcgguuuuuuucuccgguuuuccgcagacgacucgcccga

SEQ ID NO: 11563 - RNA, 51 nt, Artificial Sequence
  Description of Artificial Sequence: Synthetic oligonucleotide
gggaggacgaugcggaccuuucuaaucuuucuccgcagacgacucgcccga

SEQ ID NO: 11564 - RNA, 51 nt, Artificial Sequence
  Description of Artificial Sequence: Synthetic oligonucleotide
gggaggacgaugcggauccuuuuuguuuuucgccgcagacgacucgcccga

SEQ ID NO: 11565 - RNA, 51 nt, Artificial Sequence
  Description of Artificial Sequence: Synthetic oligonucleotide
gggaggacgaugcgguuuuuucuaucucuucuccgcagacgacucgcccga

SEQ ID NO: 11566 - RNA, 51 nt, Artificial Sequence
  Description of Artificial Sequence: Synthetic oligonucleotide
gggaggacgaugcgguuuucaugacuuuuugcccgcagacgacucgcccga

SEQ ID NO: 11567 - RNA, 52 nt, Artificial Sequence
  Description of Artificial Sequence: Synthetic oligonucleotide
gggaggacgaugcggauucuugcuuuuuuuuugccgcagacgacucgcccga

SEQ ID NO: 11568 - RNA, 51 nt, Artificial Sequence
  Description of Artificial Sequence: Synthetic oligonucleotide
gggaggacgaugcgguuuacuguuuccuuuuucgccagacgacucgcccga

SEQ ID NO: 11569 - RNA, 51 nt, Artificial Sequence
  Description of Artificial Sequence: Synthetic oligonucleotide
gggaggacgaugcggcuuuuuauucuuuuucaccgcagacgacucgcccga

SEQ ID NO: 11570 - RNA, 51 nt, Artificial Sequence
  Description of Artificial Sequence: Synthetic oligonucleotide
gggaggacgaugcggacuuuuguuacuuuuuaccccagacgacucgcccga

SEQ ID NO: 11571 - RNA, 51 nt, Artificial Sequence
  Description of Artificial Sequence: Synthetic oligonucleotide
gggaggacgaugcgguuaccuuuccuuuuacuccgcagacgacucgcccga

SEQ ID NO: 11572 - RNA, 51 nt, Artificial Sequence
  Description of Artificial Sequence: Synthetic oligonucleotide
gggaggacgaugcgguuuauuuuccugugcuuccgcagacgacucgcccga

SEQ ID NO: 11573 - RNA, 51 nt, Artificial Sequence
  Description of Artificial Sequence: Synthetic oligonucleotide
gggaggacgaugcggcuuauuucauuccucuuccgcagacgacucgcccga

SEQ ID NO: 11574 - RNA, 51 nt, Artificial Sequence
  Description of Artificial Sequence: Synthetic oligonucleotide
gggaggacgaugcggaauuucucguuuuuuugcugcagacgacucgcccga

SEQ ID NO: 11575 - RNA, 52 nt, Artificial Sequence
  Description of Artificial Sequence: Synthetic oligonucleotide
gggaggacgaugcggucauuacuguuuuuuuauccgcagacgacucgcccga

SEQ ID NO: 11576 - RNA, 51 nt, Artificial Sequence
  Description of Artificial Sequence: Synthetic oligonucleotide
gggaggacgaugcggccuauuucuuucuucuuccgcagacgacucgcccga

SEQ ID NO: 11577 - RNA, 51 nt, Artificial Sequence
  Description of Artificial Sequence: Synthetic oligonucleotide
gggaggacgaugcgguuuuuacucuuuuugguccccagacgacucgcccga

SEQ ID NO: 11578 - RNA, 51 nt, Artificial Sequence
  Description of Artificial Sequence: Synthetic oligonucleotide
gggaggacgaugcggaccuuuugucuuuuuuaccgcagacgacucgcccga

SEQ ID NO: 11579 - RNA, 51 nt, Artificial Sequence
  Description of Artificial Sequence: Synthetic oligonucleotide
gggaggacgaugcgguauuuucuaccuuuuuuccgcagacgacucgcccga

SEQ ID NO: 11580 - RNA, 51 nt, Artificial Sequence
  Description of Artificial Sequence: Synthetic oligonucleotide
gggaggacgaugcgguauuucuuuuauuccuugugcagacgacucgcccga

SEQ ID NO: 11581 - RNA, 52 nt, Artificial Sequence
  Description of Artificial Sequence: Synthetic oligonucleotide
gggaggacgaugcggacuuuuuuucucuccuuuccgcagacgacucgcccga

SEQ ID NO: 11582 - RNA, 51 nt, Artificial Sequence
  Description of Artificial Sequence: Synthetic oligonucleotide
gggaggacgaugcggauuuuucauuugcucuaccgcagacgacucgcccga

SEQ ID NO: 11583 - RNA, 51 nt, Artificial Sequence
  Description of Artificial Sequence: Synthetic oligonucleotide
gggaggacgaugcgguuauuuaccuuuccuuuccgcagacgacucgcccga

SEQ ID NO: 11584 - RNA, 51 nt, Artificial Sequence
  Description of Artificial Sequence: Synthetic oligonucleotide
gggaggacgaugcgguucuuuuuguuuuuccccggcagacgacucgcccga

SEQ ID NO: 11585 - RNA, 51 nt, Artificial Sequence
  Description of Artificial Sequence: Synthetic oligonucleotide
gggaggacgaugcgguuauugcuuuuuuugguccgcagacgacucgcccga

SEQ ID NO: 11586 - RNA, 51 nt, Artificial Sequence
  Description of Artificial Sequence: Synthetic oligonucleotide
gggaggacgaugcgguuauuuaacuccuuucuccgcagacgacucgcccga

SEQ ID NO: 11587 - RNA, 52 nt, Artificial Sequence
  Description of Artificial Sequence: Synthetic oligonucleotide
gggaggacgaugcggcauucuucuguuuuccuucgccagacgacucgcccga

SEQ ID NO: 11588 - RNA, 51 nt, Artificial Sequence
  Description of Artificial Sequence: Synthetic oligonucleotide
gggaggacgaugcgguuucacuuuuauuccugccgcagacgacucgcccga

SEQ ID NO: 11589 - RNA, 51 nt, Artificial Sequence
  Description of Artificial Sequence: Synthetic oligonucleotide
gggaggacgaugcggcuuucacuuuuuucucuccgcagacgacucgcccga

SEQ ID NO: 11590 - RNA, 51 nt, Artificial Sequence
  Description of Artificial Sequence: Synthetic oligonucleotide
gggaggacgaugcgguuuuuaauguucuucguccgcagacgacucgcccga

SEQ ID NO: 11591 - RNA, 51 nt, Artificial Sequence
  Description of Artificial Sequence: Synthetic oligonucleotide
gggaggacgaugcgguguuuuuucuauuguucccgcagacgacucgcccga

SEQ ID NO: 11592 - RNA, 51 nt, Artificial Sequence
  Description of Artificial Sequence: Synthetic oligonucleotide
gggaggacgaugcggucuuuaauucgcuuuucccgcagacgacucgcccga

SEQ ID NO: 11593 - RNA, 51 nt, Artificial Sequence
  Description of Artificial Sequence: Synthetic oligonucleotide
gggaggacgaugcggguuuauuaucuuuccuaccgcagacgacucgcccga

SEQ ID NO: 11594 - RNA, 51 nt, Artificial Sequence
  Description of Artificial Sequence: Synthetic oligonucleotide
gggaggacgaugcgguuugguuuuaauuuuucccgcagacgacucgcccga

SEQ ID NO: 11595 - RNA, 51 nt, Artificial Sequence
  Description of Artificial Sequence: Synthetic oligonucleotide
gggaggacgaugcgguauuguucauguuuucucugcagacgacucgcccga

SEQ ID NO: 11596 - RNA, 50 nt, Artificial Sequence
  Description of Artificial Sequence: Synthetic oligonucleotide
gggaggacgaugcgguuauuuuuuguuuguugugcagacgacucgcccga

SEQ ID NO: 11597 - RNA, 51 nt, Artificial Sequence
  Description of Artificial Sequence: Synthetic oligonucleotide
gggaggacgaugcgguuugggguuuucccaugccccagacgacucgcccga

SEQ ID NO: 11598 - RNA, 51 nt, Artificial Sequence
  Description of Artificial Sequence: Synthetic oligonucleotide
gggaggacgaugcggaauuauguguuuugugaccgcagacgacucgcccga

SEQ ID NO: 11599 - RNA, 51 nt, Artificial Sequence
  Description of Artificial Sequence: Synthetic oligonucleotide
gggaggacgaugcgguuauuuuuguuaccguuccgcagacgacucgcccga

SEQ ID NO: 11600 - RNA, 51 nt, Artificial Sequence
  Description of Artificial Sequence: Synthetic oligonucleotide
gggaggacgaugcgggguguguuacccuacugcgccagacgacucgcccga

SEQ ID NO: 11601 - RNA, 51 nt, Artificial Sequence
  Description of Artificial Sequence: Synthetic oligonucleotide
gggaggacgaugcgguacuuuccuuuugcucuccgcagacgacucgcccga

SEQ ID NO: 11602 - RNA, 51 nt, Artificial Sequence
  Description of Artificial Sequence: Synthetic oligonucleotide
gggaggacgaugcgguuuuuccauuuauuucgccgcagacgacucgcccga

SEQ ID NO: 11603 - RNA, 51 nt, Artificial Sequence
  Description of Artificial Sequence: Synthetic oligonucleotide
gggaggacgaugcggcuauacucuucucuuuuccgcagacgacucgcccga

SEQ ID NO: 11604 - RNA, 52 nt, Artificial Sequence
  Description of Artificial Sequence: Synthetic oligonucleotide
gggaggacgaugcgguuuuacuuguuuuuuuguccgcagacgacucgcccga

SEQ ID NO: 11605 - RNA, 51 nt, Artificial Sequence
  Description of Artificial Sequence: Synthetic oligonucleotide
gggaggacgaugcgguucuauuuucguuucuuccgcagacgacucgcccga

SEQ ID NO: 11606 - RNA, 51 nt, Artificial Sequence
  Description of Artificial Sequence: Synthetic oligonucleotide
gggaggacgaugcgguuuucucauuacauuuuccgcagacgacucgcccga

SEQ ID NO: 11607 - RNA, 51 nt, Artificial Sequence
  Description of Artificial Sequence: Synthetic oligonucleotide
gggaggacgaugcggacuuuuuauucuuucuacugcagacgacucgcccga

SEQ ID NO: 11608 - RNA, 51 nt, Artificial Sequence
  Description of Artificial Sequence: Synthetic oligonucleotide
gggaggacgaugcggacuuacuguuuucuuuuccgcagacgacucgcccga

SEQ ID NO: 11609 - RNA, 51 nt, Artificial Sequence
  Description of Artificial Sequence: Synthetic oligonucleotide
gggaggacgaugcggauuucuuucuuuuuccucugcagacgacucgcccga

SEQ ID NO: 11610 - RNA, 51 nt, Artificial Sequence
  Description of Artificial Sequence: Synthetic oligonucleotide
gggaggacgaugcggcuuuuuucuguuuuuauccgcagacgacucgcccga

SEQ ID NO: 11611 - RNA, 51 nt, Artificial Sequence
  Description of Artificial Sequence: Synthetic oligonucleotide
gggaggacgaugcgguucuuugcuuuuauuuuccccagacgacucgcccga

SEQ ID NO: 11612 - RNA, 52 nt, Artificial Sequence
  Description of Artificial Sequence: Synthetic oligonucleotide
gggaggacgaugcggauucguuuuuuucuuguuccgcagacgacucgcccga

SEQ ID NO: 11613 - RNA, 51 nt, Artificial Sequence
  Description of Artificial Sequence: Synthetic oligonucleotide
gggaggacgaugcgguuuuccuucgcuucuuuccgcagacgacucgcccga

SEQ ID NO: 11614 - RNA, 50 nt, Artificial Sequence
  Description of Artificial Sequence: Synthetic oligonucleotide
gggaggacgaugcggucucaucuacuuuucuccgcagacgacucgcccga

SEQ ID NO: 11615 - RNA, 51 nt, Artificial Sequence
  Description of Artificial Sequence: Synthetic oligonucleotide
gggaggacgaugcggguauuucucuuuucucuccgcagacgacucgcccga

SEQ ID NO: 11616 - RNA, 51 nt, Artificial Sequence
  Description of Artificial Sequence: Synthetic oligonucleotide
gggaggacgaugcggucuuuuguuauucuuguccccagacgacucgcccga

SEQ ID NO: 11617 - RNA, 51 nt, Artificial Sequence
  Description of Artificial Sequence: Synthetic oligonucleotide
gggaggacgaugcgguuucuuuauucuacucuccgcagacgacucgcccga

SEQ ID NO: 11618 - RNA, 51 nt, Artificial Sequence
  Description of Artificial Sequence: Synthetic oligonucleotide
gggaggacgaugcgguguaguggagguggugugcgcagacgacucgcccga

SEQ ID NO: 11619 - RNA, 51 nt, Artificial Sequence
  Description of Artificial Sequence: Synthetic oligonucleotide
gggaggacgaugcggcuucuacucacuuucuuccgcagacgacucgcccga

SEQ ID NO: 11620 - RNA, 51 nt, Artificial Sequence
  Description of Artificial Sequence: Synthetic oligonucleotide
gggaggacgaugcgguauuuuguucucuuuuugcccagacgacucgcccga

SEQ ID NO: 11621 - RNA, 52 nt, Artificial Sequence
  Description of Artificial Sequence: Synthetic oligonucleotide
gggaggacgaugcggauuucacguuguuuuuuaccgcagacgacucgcccga

SEQ ID NO: 11622 - RNA, 51 nt, Artificial Sequence
  Description of Artificial Sequence: Synthetic oligonucleotide
gggaggacgaugcggcuuacucuuacuuuuuaccgcagacgacucgcccga

SEQ ID NO: 11623 - RNA, 51 nt, Artificial Sequence
  Description of Artificial Sequence: Synthetic oligonucleotide
gggaggacgaugcgguuuuuacuuuuuucguuccgcagacgacucgcccga

SEQ ID NO: 11624 - RNA, 51 nt, Artificial Sequence
  Description of Artificial Sequence: Synthetic oligonucleotide
gggaggacgaugcgguuucauauuucuuucuucgccagacgacucgcccga

SEQ ID NO: 11625 - RNA, 50 nt, Artificial Sequence
  Description of Artificial Sequence: Synthetic oligonucleotide
gggaggacgaugcggcuuuuuucuuuuuucuccgcagacgacucgcccga

SEQ ID NO: 11626 - RNA, 51 nt, Artificial Sequence
  Description of Artificial Sequence: Synthetic oligonucleotide
gggaggacgaugcggccuuuuuucuuuguuuuccgcagacgacucgcccga

SEQ ID NO: 11627 - RNA, 51 nt, Artificial Sequence
  Description of Artificial Sequence: Synthetic oligonucleotide
gggaggacgaugcggcuuuuuauacuuuuuuuccgcagacgacucgcccga

SEQ ID NO: 11628 - RNA, 51 nt, Artificial Sequence
  Description of Artificial Sequence: Synthetic oligonucleotide
gggaggacgaugcggcuuguuugcuuucuucuccgcagacgacucgcccga

SEQ ID NO: 11629 - RNA, 51 nt, Artificial Sequence
  Description of Artificial Sequence: Synthetic oligonucleotide
gggaggacgaugcgguuuguuuuugugcuuuuccccagacgacucgcccga

SEQ ID NO: 11630 - RNA, 51 nt, Artificial Sequence
  Description of Artificial Sequence: Synthetic oligonucleotide
gggaggacgaugcggaucuuuguucucuauuaccgcagacgacucgcccga

SEQ ID NO: 11631 - RNA, 51 nt, Artificial Sequence
  Description of Artificial Sequence: Synthetic oligonucleotide
gggaggacgaugcggcuuucuacuucuucucaccgcagacgacucgcccga

SEQ ID NO: 11632 - RNA, 51 nt, Artificial Sequence
  Description of Artificial Sequence: Synthetic oligonucleotide
gggaggacgaugcgguucuuuugcgccuuuuuccgcagacgacucgcccga

SEQ ID NO: 11633 - RNA, 51 nt, Artificial Sequence
  Description of Artificial Sequence: Synthetic oligonucleotide
gggaggacgaugcggauuuauuuucuuuucagccgcagacgacucgcccga

SEQ ID NO: 11634 - RNA, 51 nt, Artificial Sequence
  Description of Artificial Sequence: Synthetic oligonucleotide
gggaggacgaugcgguuuuuccuauuaugcuuccgcagacgacucgcccga

SEQ ID NO: 11635 - RNA, 51 nt, Artificial Sequence
  Description of Artificial Sequence: Synthetic oligonucleotide
gggaggacgaugcgguuuuuugucuaucuuuuccgcagacgacucgcccga

SEQ ID NO: 11636 - RNA, 51 nt, Artificial Sequence
  Description of Artificial Sequence: Synthetic oligonucleotide
gggaggacgaugcgguucuuucuuuuuuccuuccgcagacgacucgcccga

SEQ ID NO: 11637 - RNA, 51 nt, Artificial Sequence
  Description of Artificial Sequence: Synthetic oligonucleotide
gggaggacgaugcggcuuucauuccuuuuuucccgcagacgacucgcccga

SEQ ID NO: 11638 - RNA, 52 nt, Artificial Sequence
  Description of Artificial Sequence: Synthetic oligonucleotide
gggaggacgaugcgguuucacacuuuuuuuuugcugcagacgacucgcccga

SEQ ID NO: 11639 - RNA, 51 nt, Artificial Sequence
  Description of Artificial Sequence: Synthetic oligonucleotide
gggaggacgaugcggauuuuuucuaguuuuugcugcagacgacucgcccga

SEQ ID NO: 11640 - RNA, 51 nt, Artificial Sequence
  Description of Artificial Sequence: Synthetic oligonucleotide
gggaggacgaugcgguuuuucuuuuaacuuuuccgcagacgacucgcccga

SEQ ID NO: 11641 - RNA, 52 nt, Artificial Sequence
  Description of Artificial Sequence: Synthetic oligonucleotide
gggaggacgaugcggguucuuuuauuuguuuuuccccagacgacucgcccga

SEQ ID NO: 11642 - RNA, 51 nt, Artificial Sequence
  Description of Artificial Sequence: Synthetic oligonucleotide
gggaggacgaugcgguuauuuaaauuuuuguugugcagacgacucgcccga

SEQ ID NO: 11643 - RNA, 52 nt, Artificial Sequence
  Description of Artificial Sequence: Synthetic oligonucleotide
gggaggacgaugcggucuguugugcuugauaugccccagacgacucgcccga

SEQ ID NO: 11644 - RNA, 51 nt, Artificial Sequence
  Description of Artificial Sequence: Synthetic oligonucleotide
gggaggacgaugcgguuuucuuguuuauuccaccgcagacgacucgcccga

SEQ ID NO: 11645 - RNA, 51 nt, Artificial Sequence
  Description of Artificial Sequence: Synthetic oligonucleotide
gggaggacgaugcgguauacuuuuuucuuccgccgcagacgacucgcccga

SEQ ID NO: 11646 - RNA, 51 nt, Artificial Sequence
  Description of Artificial Sequence: Synthetic oligonucleotide
gggaggacgaugcggucuuuaucauucuguuuccgcagacgacucgcccga

SEQ ID NO: 11647 - RNA, 51 nt, Artificial Sequence
  Description of Artificial Sequence: Synthetic oligonucleotide
gggaggacgaugcgggucuuuucuuguuuucugcccagacgacucgcccga

SEQ ID NO: 11648 - RNA, 51 nt, Artificial Sequence
  Description of Artificial Sequence: Synthetic oligonucleotide
gggaggacgaugcgguauuuuauucuaucccuccgcagacgacucgcccga

SEQ ID NO: 11649 - RNA, 51 nt, Artificial Sequence
  Description of Artificial Sequence: Synthetic oligonucleotide
gggaggacgaugcggcucuuuaaccuuucuuuccgcagacgacucgcccga

SEQ ID NO: 11650 - RNA, 51 nt, Artificial Sequence
  Description of Artificial Sequence: Synthetic oligonucleotide
gggaggacgaugcgguuuccgguucuuuuuuuccgcagacgacucgcccga

SEQ ID NO: 11651 - RNA, 51 nt, Artificial Sequence
  Description of Artificial Sequence: Synthetic oligonucleotide
gggaggacgaugcggauuucuuauuccuuaccccgcagacgacucgcccga

SEQ ID NO: 11652 - RNA, 51 nt, Artificial Sequence
  Description of Artificial Sequence: Synthetic oligonucleotide
gggaggacgaugcggacuucucuuuccuauuaccgcagacgacucgcccga

SEQ ID NO: 11653 - RNA, 51 nt, Artificial Sequence
  Description of Artificial Sequence: Synthetic oligonucleotide
gggaggacgaugcggcuuucuuucucuuuuucccgcagacgacucgcccga

SEQ ID NO: 11654 - RNA, 51 nt, Artificial Sequence
  Description of Artificial Sequence: Synthetic oligonucleotide
gggaggacgaugcggguuuacauuuucuucuuccgcagacgacucgcccga

SEQ ID NO: 11655 - RNA, 51 nt, Artificial Sequence
  Description of Artificial Sequence: Synthetic oligonucleotide
gggaggacgaugcggcuuuuuuuccuuuauuuccgcagacgacucgcccga

SEQ ID NO: 11656 - RNA, 51 nt, Artificial Sequence
  Description of Artificial Sequence: Synthetic oligonucleotide
gggaggacgaugcgguuuuuuacgccuuuuucccgcagacgacucgcccga

SEQ ID NO: 11657 - RNA, 51 nt, Artificial Sequence
  Description of Artificial Sequence: Synthetic oligonucleotide
gggaggacgaugcgguuauauuacuuuuccuucugcagacgacucgcccga

SEQ ID NO: 11658 - RNA, 51 nt, Artificial Sequence
  Description of Artificial Sequence: Synthetic oligonucleotide
gggaggacgaugcggaucccuuucuuuuucccccgcagacgacucgcccga

SEQ ID NO: 11659 - RNA, 51 nt, Artificial Sequence
  Description of Artificial Sequence: Synthetic oligonucleotide
gggaggacgaugcggaauuuucuuguuugcugccccagacgacucgcccga

SEQ ID NO: 11660 - RNA, 51 nt, Artificial Sequence
  Description of Artificial Sequence: Synthetic oligonucleotide
gggaggacgaugcgguuugggaguagggugcuccgcagacgacucgcccga

SEQ ID NO: 11661 - RNA, 51 nt, Artificial Sequence
  Description of Artificial Sequence: Synthetic oligonucleotide
gggaggacgaugcggcuuucuucugacuuucuccgcagacgacucgcccga

SEQ ID NO: 11662 - RNA, 51 nt, Artificial Sequence
  Description of Artificial Sequence: Synthetic oligonucleotide
gggaggacgaugcggucuguuuuucuuccuuugcccagacgacucgcccga

SEQ ID NO: 11663 - RNA, 51 nt, Artificial Sequence
  Description of Artificial Sequence: Synthetic oligonucleotide
gggaggacgaugcggaucuuuaauacuucucuccgcagacgacucgcccga

SEQ ID NO: 11664 - RNA, 51 nt, Artificial Sequence
  Description of Artificial Sequence: Synthetic oligonucleotide
gggaggacgaugcgguuucuaucuuccuuacuccgcagacgacucgcccga

SEQ ID NO: 11665 - RNA, 51 nt, Artificial Sequence
  Description of Artificial Sequence: Synthetic oligonucleotide
gggaggacgaugcgguauuuucuuuuuucgcugcccagacgacucgcccga

SEQ ID NO: 11666 - RNA, 51 nt, Artificial Sequence
  Description of Artificial Sequence: Synthetic oligonucleotide
gggaggacgaugcggcuugcuuuuucauuuuuccgcagacgacucgcccga

SEQ ID NO: 11667 - RNA, 51 nt, Artificial Sequence
  Description of Artificial Sequence: Synthetic oligonucleotide
gggaggacgaugcgguuuuuuacauucucucucugcagacgacucgcccga

SEQ ID NO: 11668 - RNA, 51 nt, Artificial Sequence
  Description of Artificial Sequence: Synthetic oligonucleotide
gggaggacgaugcggcuuuucauacgcuuuuuccgcagacgacucgcccga

SEQ ID NO: 11669 - RNA, 51 nt, Artificial Sequence
  Description of Artificial Sequence: Synthetic oligonucleotide
gggaggacgaugcgggcuauucuuuucuuuuuccccagacgacucgcccga

SEQ ID NO: 11670 - RNA, 51 nt, Artificial Sequence
  Description of Artificial Sequence: Synthetic oligonucleotide
gggaggacgaugcgguuuauuuuagucucuucccgcagacgacucgcccga

SEQ ID NO: 11671 - RNA, 51 nt, Artificial Sequence
  Description of Artificial Sequence: Synthetic oligonucleotide
gggaggacgaugcgguucauuuuuguuuucucccgcagacgacucgcccga

SEQ ID NO: 11672 - RNA, 52 nt, Artificial Sequence
  Description of Artificial Sequence: Synthetic oligonucleotide
gggaggacgaugcgguuuacuuuuuuacgcuuuccccagacgacucgcccga

SEQ ID NO: 11673 - RNA, 51 nt, Artificial Sequence
  Description of Artificial Sequence: Synthetic oligonucleotide
gggaggacgaugcggguuuucuaccuucuuuaccgcagacgacucgcccga

SEQ ID NO: 11674 - RNA, 50 nt, Artificial Sequence
  Description of Artificial Sequence: Synthetic oligonucleotide
gggaggacgaugcgguuugggguuucccgugccgcagacgacucgcccga

SEQ ID NO: 11675 - RNA, 51 nt, Artificial Sequence
  Description of Artificial Sequence: Synthetic oligonucleotide
gggaggacgaugcgguuuuuaccuuuuuccuuccgcagacgacucgcccga

SEQ ID NO: 11676 - RNA, 51 nt, Artificial Sequence
  Description of Artificial Sequence: Synthetic oligonucleotide
gggaggacgaugcgguucaucgcuguuuuucuccgcagacgacucgcccga

SEQ ID NO: 11677 - RNA, 52 nt, Artificial Sequence
  Description of Artificial Sequence: Synthetic oligonucleotide
gggaggacgaugcggacuuuuuuuugucuucugccgcagacgacucgcccga

SEQ ID NO: 11678 - RNA, 51 nt, Artificial Sequence
  Description of Artificial Sequence: Synthetic oligonucleotide
gggaggacgaugcggcgauuuuucuucuuuugcgccagacgacucgcccga

SEQ ID NO: 11679 - RNA, 51 nt, Artificial Sequence
  Description of Artificial Sequence: Synthetic oligonucleotide
gggaggacgaugcggucuuuuuucauuucucaccgcagacgacucgcccga

SEQ ID NO: 11680 - RNA, 51 nt, Artificial Sequence
  Description of Artificial Sequence: Synthetic oligonucleotide
gggaggacgaugcggauuuuuucucuuauuugccgcagacgacucgcccga

SEQ ID NO: 11681 - RNA, 52 nt, Artificial Sequence
  Description of Artificial Sequence: Synthetic oligonucleotide
gggaggacgaugcggauuuuuccuugucuuauaccgcagacgacucgcccga

SEQ ID NO: 11682 - RNA, 51 nt, Artificial Sequence
  Description of Artificial Sequence: Synthetic oligonucleotide
gggaggacgaugcgguuccuuuuaccuuuucgccgcagacgacucgcccga

SEQ ID NO: 11683 - RNA, 51 nt, Artificial Sequence
  Description of Artificial Sequence: Synthetic oligonucleotide
gggaggacgaugcggccuuucuuuucucuacuccgcagacgacucgcccga

SEQ ID NO: 11684 - RNA, 51 nt, Artificial Sequence
  Description of Artificial Sequence: Synthetic oligonucleotide
gggaggacgaugcgguuucuacuuuuucuuuuccccagacgacucgcccga

SEQ ID NO: 11685 - RNA, 51 nt, Artificial Sequence
  Description of Artificial Sequence: Synthetic oligonucleotide
gggaggacgaugcgguuuuuacccuuuuuuguccgcagacgacucgcccga

SEQ ID NO: 11686 - RNA, 51 nt, Artificial Sequence
  Description of Artificial Sequence: Synthetic oligonucleotide
gggaggacgaugcggcuuguuuccuuuuuucuccgcagacgacucgcccga

SEQ ID NO: 11687 - RNA, 51 nt, Artificial Sequence
  Description of Artificial Sequence: Synthetic oligonucleotide
gggaggacgaugcggucuuuuuuucauuuuuuccgcagacgacucgcccga

SEQ ID NO: 11688 - RNA, 51 nt, Artificial Sequence
  Description of Artificial Sequence: Synthetic oligonucleotide
gggaggacgaugcggucuuauucuuucuucuccgccagacgacucgcccga

SEQ ID NO: 11689 - RNA, 51 nt, Artificial Sequence
  Description of Artificial Sequence: Synthetic oligonucleotide
gggaggacgaugcgguucuuuuuaacuuacuuccgcagacgacucgcccga

SEQ ID NO: 11690 - RNA, 52 nt, Artificial Sequence
  Description of Artificial Sequence: Synthetic oligonucleotide
gggaggacgaugcgguuuuucucuuuuuuuccgccgcagacgacucgcccga

SEQ ID NO: 11691 - RNA, 51 nt, Artificial Sequence
  Description of Artificial Sequence: Synthetic oligonucleotide
gggaggacgaugcgguuuuuuauuuguuaguugugcagacgacucgcccga

SEQ ID NO: 11692 - RNA, 51 nt, Artificial Sequence
  Description of Artificial Sequence: Synthetic oligonucleotide
gggaggacgaugcgguuuuucacacauuauuuccgcagacgacucgcccga

SEQ ID NO: 11693 - RNA, 52 nt, Artificial Sequence
  Description of Artificial Sequence: Synthetic oligonucleotide
gggaggacgaugcgguuuguuuauucuuuuuuuccgcagacgacucgcccga

SEQ ID NO: 11694 - RNA, 49 nt, Artificial Sequence
  Description of Artificial Sequence: Synthetic oligonucleotide
gggaggacgaugcgguccugucgucuucguccccagacgacucgcccga

SEQ ID NO: 11695 - RNA, 51 nt, Artificial Sequence
  Description of Artificial Sequence: Synthetic oligonucleotide
gggaggacgaugcgguauuuucuucucucgguccgcagacgacucgcccga

SEQ ID NO: 11696 - RNA, 51 nt, Artificial Sequence
  Description of Artificial Sequence: Synthetic oligonucleotide
gggaggacgaugcggaucucuucuuucuuaccccgcagacgacucgcccga

SEQ ID NO: 11697 - RNA, 51 nt, Artificial Sequence
  Description of Artificial Sequence: Synthetic oligonucleotide
gggaggacgaugcgguuucuauuuccuuugccccgcagacgacucgcccga

SEQ ID NO: 11698 - RNA, 51 nt, Artificial Sequence
  Description of Artificial Sequence: Synthetic oligonucleotide
gggaggacgaugcgguuuauauuuucucgccuccgcagacgacucgcccga

SEQ ID NO: 11699 - RNA, 51 nt, Artificial Sequence
  Description of Artificial Sequence: Synthetic oligonucleotide
gggaggacgaugcgggcuucuucuuucuucauccgcagacgacucgcccga

SEQ ID NO: 11700 - RNA, 51 nt, Artificial Sequence
  Description of Artificial Sequence: Synthetic oligonucleotide
gggaggacgaugcgguaucuuguuacuuuuucccccagacgacucgcccga

SEQ ID NO: 11701 - RNA, 50 nt, Artificial Sequence
  Description of Artificial Sequence: Synthetic oligonucleotide
gggaggacgaugcggccuugucuuuuuucuuccgcagacgacucgcccga

SEQ ID NO: 11702 - RNA, 51 nt, Artificial Sequence
  Description of Artificial Sequence: Synthetic oligonucleotide
gggaggacgaugcgguuucucuuauucuccuuccgcagacgacucgcccga

SEQ ID NO: 11703 - RNA, 51 nt, Artificial Sequence
  Description of Artificial Sequence: Synthetic oligonucleotide
gggaggacgaugcgguaguguuuuuuuuuugugcccagacgacucgcccga

SEQ ID NO: 11704 - RNA, 51 nt, Artificial Sequence
  Description of Artificial Sequence: Synthetic oligonucleotide
gggaggacgaugcggauuucuaucgcuuuuucccgcagacgacucgcccga

SEQ ID NO: 11705 - RNA, 51 nt, Artificial Sequence
  Description of Artificial Sequence: Synthetic oligonucleotide
gggaggacgaugcggucauuuugucuuuuauuccgcagacgacucgcccga

SEQ ID NO: 11706 - RNA, 51 nt, Artificial Sequence
  Description of Artificial Sequence: Synthetic oligonucleotide
gggaggacgaugcggaucuuucuuucucuuaccgccagacgacucgcccga

SEQ ID NO: 11707 - RNA, 51 nt, Artificial Sequence
  Description of Artificial Sequence: Synthetic oligonucleotide
gggaggacgaugcggcuuucuaauacucuucuccgcagacgacucgcccga

SEQ ID NO: 11708 - RNA, 51 nt, Artificial Sequence
  Description of Artificial Sequence: Synthetic oligonucleotide
gggaggacgaugcgguuuucuagcuuuccuuuccgcagacgacucgcccga

SEQ ID NO: 11709 - RNA, 51 nt, Artificial Sequence
  Description of Artificial Sequence: Synthetic oligonucleotide
gggaggacgaugcggcuuuuauuuuguuuucaccgcagacgacucgcccga

SEQ ID NO: 11710 - RNA, 51 nt, Artificial Sequence
  Description of Artificial Sequence: Synthetic oligonucleotide
gggaggacgaugcgguuucacuaucuuuucucccgcagacgacucgcccga

SEQ ID NO: 11711 - RNA, 51 nt, Artificial Sequence
  Description of Artificial Sequence: Synthetic oligonucleotide
gggaggacgaugcggauccuuuuguuuucuuaccgcagacgacucgcccga

SEQ ID NO: 11712 - RNA, 51 nt, Artificial Sequence
  Description of Artificial Sequence: Synthetic oligonucleotide
gggaggacgaugcggccuuuuucauuuuuaucccgcagacgacucgcccga

SEQ ID NO: 11713 - RNA, 53 nt, Artificial Sequence
  Description of Artificial Sequence: Synthetic oligonucleotide
gggaggacgaugcgguuuguuguuguuuuuuuuucugcagacgacucgcccga

SEQ ID NO: 11714 - RNA, 51 nt, Artificial Sequence
  Description of Artificial Sequence: Synthetic oligonucleotide
gggaggacgaugcgguuugggauuuucccgugccccagacgacucgcccga

SEQ ID NO: 11715 - RNA, 51 nt, Artificial Sequence
  Description of Artificial Sequence: Synthetic oligonucleotide
gggaggacgaugcgguuuuguuugcuuugucuccgcagacgacucgcccga

SEQ ID NO: 11716 - RNA, 51 nt, Artificial Sequence
  Description of Artificial Sequence: Synthetic oligonucleotide
gggaggacgaugcggauucauucuuuuuuaccccgcagacgacucgcccga

SEQ ID NO: 11717 - RNA, 51 nt, Artificial Sequence
  Description of Artificial Sequence: Synthetic oligonucleotide
gggaggacgaugcggcuuauuucuuccgguuuccgcagacgacucgcccga

SEQ ID NO: 11718 - RNA, 51 nt, Artificial Sequence
  Description of Artificial Sequence: Synthetic oligonucleotide
gggaggacgaugcgguauuucuuuuacuuuugccccagacgacucgcccga

SEQ ID NO: 11719 - RNA, 51 nt, Artificial Sequence
  Description of Artificial Sequence: Synthetic oligonucleotide
gggaggacgaugcgguuuuuccuuuuaacuuuccgcagacgacucgcccga

SEQ ID NO: 11720 - RNA, 51 nt, Artificial Sequence
  Description of Artificial Sequence: Synthetic oligonucleotide
gggaggacgaugcgguuccuuuauuuuucucgccgcagacgacucgcccga

SEQ ID NO: 11721 - RNA, 51 nt, Artificial Sequence
  Description of Artificial Sequence: Synthetic oligonucleotide
gggaggacgaugcgguauuuuuccacuguuuuccgcagacgacucgcccga

SEQ ID NO: 11722 - RNA, 51 nt, Artificial Sequence
  Description of Artificial Sequence: Synthetic oligonucleotide
gggaggacgaugcggcguuuuacuuauucuuuccgcagacgacucgcccga

SEQ ID NO: 11723 - RNA, 51 nt, Artificial Sequence
  Description of Artificial Sequence: Synthetic oligonucleotide
gggaggacgaugcgguucacuucuuuauucucccgcagacgacucgcccga

SEQ ID NO: 11724 - RNA, 51 nt, Artificial Sequence
  Description of Artificial Sequence: Synthetic oligonucleotide
gggaggacgaugcgguuuuuucauccuuuugucugcagacgacucgcccga

SEQ ID NO: 11725 - RNA, 51 nt, Artificial Sequence
  Description of Artificial Sequence: Synthetic oligonucleotide
gggaggacgaugcgguuuccuacuuuuuucuuccgcagacgacucgcccga

SEQ ID NO: 11726 - RNA, 51 nt, Artificial Sequence
  Description of Artificial Sequence: Synthetic oligonucleotide
gggaggacgaugcggacuuuuuuauucuuuuuccgcagacgacucgcccga

SEQ ID NO: 11727 - RNA, 51 nt, Artificial Sequence
  Description of Artificial Sequence: Synthetic oligonucleotide
gggaggacgaugcgguuauucuuaauucuuuuccgcagacgacucgcccga

SEQ ID NO: 11728 - RNA, 51 nt, Artificial Sequence
  Description of Artificial Sequence: Synthetic oligonucleotide
gggaggacgaugcggucuuucucuccucuuugccgcagacgacucgcccga

SEQ ID NO: 11729 - RNA, 51 nt, Artificial Sequence
  Description of Artificial Sequence: Synthetic oligonucleotide
gggaggacgaugcggaucucugguuucuuucuccgcagacgacucgcccga

SEQ ID NO: 11730 - RNA, 51 nt, Artificial Sequence
  Description of Artificial Sequence: Synthetic oligonucleotide
gggaggacgaugcgguuacugcuuauuucucuccgcagacgacucgcccga

SEQ ID NO: 11731 - RNA, 51 nt, Artificial Sequence
  Description of Artificial Sequence: Synthetic oligonucleotide
gggaggacgaugcgguuuucuuuucuguuuauccgcagacgacucgcccga

SEQ ID NO: 11732 - RNA, 51 nt, Artificial Sequence
  Description of Artificial Sequence: Synthetic oligonucleotide
gggaggacgaugcgguucuacuucuuucuucaccgcagacgacucgcccga

SEQ ID NO: 11733 - RNA, 51 nt, Artificial Sequence
  Description of Artificial Sequence: Synthetic oligonucleotide
gggaggacgaugcggcuuuuucguuuuuuccaccgcagacgacucgcccga

SEQ ID NO: 11734 - RNA, 51 nt, Artificial Sequence
  Description of Artificial Sequence: Synthetic oligonucleotide
gggaggacgaugcgguuguucuuucauuuucuccgcagacgacucgcccga

SEQ ID NO: 11735 - RNA, 51 nt, Artificial Sequence
  Description of Artificial Sequence: Synthetic oligonucleotide
gggaggacgaugcggcuuuuaauuguucccuuccgcagacgacucgcccga

SEQ ID NO: 11736 - RNA, 51 nt, Artificial Sequence
  Description of Artificial Sequence: Synthetic oligonucleotide
gggaggacgaugcggacuauuuucuguuuucaccgcagacgacucgcccga

SEQ ID NO: 11737 - RNA, 51 nt, Artificial Sequence
  Description of Artificial Sequence: Synthetic oligonucleotide
gggaggacgaugcggccuuauuuacuuuuacuccgcagacgacucgcccga

SEQ ID NO: 11738 - RNA, 52 nt, Artificial Sequence
  Description of Artificial Sequence: Synthetic oligonucleotide
gggaggacgaugcgguuuuucagguuuuuuucgcaucagacgacucgcccga

SEQ ID NO: 11739 - RNA, 52 nt, Artificial Sequence
  Description of Artificial Sequence: Synthetic oligonucleotide
gggaggacgaugcgguccugucgucuuguucguccccagacgacucgcccga

SEQ ID NO: 11740 - RNA, 51 nt, Artificial Sequence
  Description of Artificial Sequence: Synthetic oligonucleotide
gggaggacgaugcgguuuuaucaccuucuuguccgcagacgacucgcccga

SEQ ID NO: 11741 - RNA, 51 nt, Artificial Sequence
  Description of Artificial Sequence: Synthetic oligonucleotide
gggaggacgaugcggcuuuuacuugucuuuuaccgcagacgacucgcccga

SEQ ID NO: 11742 - RNA, 51 nt, Artificial Sequence
  Description of Artificial Sequence: Synthetic oligonucleotide
gggaggacgaugcgguuauuucuuuauuuucgcugcagacgacucgcccga

SEQ ID NO: 11743 - RNA, 51 nt, Artificial Sequence
  Description of Artificial Sequence: Synthetic oligonucleotide
gggaggacgaugcggucuuaauauguucuucuccgcagacgacucgcccga

SEQ ID NO: 11744 - RNA, 51 nt, Artificial Sequence
  Description of Artificial Sequence: Synthetic oligonucleotide
gggaggacgaugcggcuuucuuuuacuuuucaccgcagacgacucgcccga

SEQ ID NO: 11745 - RNA, 52 nt, Artificial Sequence
  Description of Artificial Sequence: Synthetic oligonucleotide
gggaggacgaugcgguuuuuuuccuaucucuguccgcagacgacucgcccga

SEQ ID NO: 11746 - RNA, 52 nt, Artificial Sequence
  Description of Artificial Sequence: Synthetic oligonucleotide
gggaggacgaugcggcuuuuccuuuuuuuuguuccgcagacgacucgcccga

SEQ ID NO: 11747 - RNA, 51 nt, Artificial Sequence
  Description of Artificial Sequence: Synthetic oligonucleotide
gggaggacgaugcgguuucucauuuucauuauccgcagacgacucgcccga

SEQ ID NO: 11748 - RNA, 51 nt, Artificial Sequence
  Description of Artificial Sequence: Synthetic oligonucleotide
gggaggacgaugcggcucuuuauuauuuuuccccgcagacgacucgcccga

SEQ ID NO: 11749 - RNA, 51 nt, Artificial Sequence
  Description of Artificial Sequence: Synthetic oligonucleotide
gggaggacgaugcggauucuuucuuauucuugcugcagacgacucgcccga

SEQ ID NO: 11750 - RNA, 51 nt, Artificial Sequence
  Description of Artificial Sequence: Synthetic oligonucleotide
gggaggacgaugcgguucuuugcuaucuuuuuccgcagacgacucgcccga

SEQ ID NO: 11751 - RNA, 51 nt, Artificial Sequence
  Description of Artificial Sequence: Synthetic oligonucleotide
gggaggacgaugcggccuuuaccucuuuuauuccgcagacgacucgcccga

SEQ ID NO: 11752 - RNA, 51 nt, Artificial Sequence
  Description of Artificial Sequence: Synthetic oligonucleotide
gggaggacgaugcggcauuuacuuucuuuucacugcagacgacucgcccga

SEQ ID NO: 11753 - RNA, 51 nt, Artificial Sequence
  Description of Artificial Sequence: Synthetic oligonucleotide
gggaggacgaugcggucgugucgucuguucguccccagacgacucgcccga

SEQ ID NO: 11754 - RNA, 51 nt, Artificial Sequence
  Description of Artificial Sequence: Synthetic oligonucleotide
gggaggacgaugcggcuauuuucucuguuccuccgcagacgacucgcccga

SEQ ID NO: 11755 - RNA, 51 nt, Artificial Sequence
  Description of Artificial Sequence: Synthetic oligonucleotide
gggaggacgaugcgguuggguguagggggguuccgcagacgacucgcccga

SEQ ID NO: 11756 - RNA, 51 nt, Artificial Sequence
  Description of Artificial Sequence: Synthetic oligonucleotide
gggaggacgaugcgguuuucacuacccuuucuccgcagacgacucgcccga

SEQ ID NO: 11757 - RNA, 51 nt, Artificial Sequence
  Description of Artificial Sequence: Synthetic oligonucleotide
gggaggacgaugcgguuguuucucuuauuucgccccagacgacucgcccga

SEQ ID NO: 11758 - RNA, 51 nt, Artificial Sequence
  Description of Artificial Sequence: Synthetic oligonucleotide
gggaggacgaugcgguuuaccuuuucaucucuccgcagacgacucgcccga

SEQ ID NO: 11759 - RNA, 51 nt, Artificial Sequence
  Description of Artificial Sequence: Synthetic oligonucleotide
gggaggacgaugcggucuuuuauuucauucauccgcagacgacucgcccga

SEQ ID NO: 11760 - RNA, 51 nt, Artificial Sequence
  Description of Artificial Sequence: Synthetic oligonucleotide
gggaggacgaugcgguuuuucucaucuuaucuccgcagacgacucgcccga

SEQ ID NO: 11761 - RNA, 51 nt, Artificial Sequence
  Description of Artificial Sequence: Synthetic oligonucleotide
gggaggacgaugcggcucuuuacuuuaucuuuccgcagacgacucgcccga

SEQ ID NO: 11762 - RNA, 51 nt, Artificial Sequence
  Description of Artificial Sequence: Synthetic oligonucleotide
gggaggacgaugcgguuucuuuauuucucuuugcgcagacgacucgcccga

SEQ ID NO: 11763 - RNA, 51 nt, Artificial Sequence
  Description of Artificial Sequence: Synthetic oligonucleotide
gggaggacgaugcggcucuuaaugcuuucucuccgcagacgacucgcccga

SEQ ID NO: 11764 - RNA, 51 nt, Artificial Sequence
  Description of Artificial Sequence: Synthetic oligonucleotide
gggaggacgaugcgguuuacuucuuuauaucuccgcagacgacucgcccga

SEQ ID NO: 11765 - RNA, 51 nt, Artificial Sequence
  Description of Artificial Sequence: Synthetic oligonucleotide
gggaggacgaugcgguuucauauuuuucuucuccgcagacgacucgcccga

SEQ ID NO: 11766 - RNA, 51 nt, Artificial Sequence
  Description of Artificial Sequence: Synthetic oligonucleotide
gggaggacgaugcgguauugcuaucuuuuuccccgcagacgacucgcccga

SEQ ID NO: 11767 - RNA, 52 nt, Artificial Sequence
  Description of Artificial Sequence: Synthetic oligonucleotide
gggaggacgaugcgguauuuuuuuuccuuuucuccgcagacgacucgcccga

SEQ ID NO: 11768 - RNA, 51 nt, Artificial Sequence
  Description of Artificial Sequence: Synthetic oligonucleotide
gggaggacgaugcggauuuuuuccuauuucuaccgcagacgacucgcccga

SEQ ID NO: 11769 - RNA, 52 nt, Artificial Sequence
  Description of Artificial Sequence: Synthetic oligonucleotide
gggaggacgaugcgguuauuguuuuauuuuuuugcccagacgacucgcccga

SEQ ID NO: 11770 - RNA, 51 nt, Artificial Sequence
  Description of Artificial Sequence: Synthetic oligonucleotide
gggaggacgaugcggcuuucuuuuuauacuuuccgcagacgacucgcccga

SEQ ID NO: 11771 - RNA, 51 nt, Artificial Sequence
  Description of Artificial Sequence: Synthetic oligonucleotide
gggaggacgaugcgguccucgucgucuugcguccccagacgacucgcccga

SEQ ID NO: 11772 - RNA, 51 nt, Artificial Sequence
  Description of Artificial Sequence: Synthetic oligonucleotide
gggaggacgaugcggucuauucauucucuuauccgcagacgacucgcccga

SEQ ID NO: 11773 - RNA, 51 nt, Artificial Sequence
  Description of Artificial Sequence: Synthetic oligonucleotide
gggaggacgaugcggaacuuuucccuuuuccaccgcagacgacucgcccga

SEQ ID NO: 11774 - RNA, 51 nt, Artificial Sequence
  Description of Artificial Sequence: Synthetic oligonucleotide
gggaggacgaugcgguuucuucuugcuucuucccgcagacgacucgcccga

SEQ ID NO: 11775 - RNA, 51 nt, Artificial Sequence
  Description of Artificial Sequence: Synthetic oligonucleotide
gggaggacgaugcgguuuuauucucguuuucuccgcagacgacucgcccga

SEQ ID NO: 11776 - RNA, 51 nt, Artificial Sequence
  Description of Artificial Sequence: Synthetic oligonucleotide
gggaggacgaugcgguuuuuccuguucuuacuccgcagacgacucgcccga

SEQ ID NO: 11777 - RNA, 51 nt, Artificial Sequence
  Description of Artificial Sequence: Synthetic oligonucleotide
gggaggacgaugcggcuuucuuaugcucuuuaccgcagacgacucgcccga

SEQ ID NO: 11778 - RNA, 51 nt, Artificial Sequence
  Description of Artificial Sequence: Synthetic oligonucleotide
gggaggacgaugcgguuuuuuccuuucacuauccgcagacgacucgcccga

SEQ ID NO: 11779 - RNA, 50 nt, Artificial Sequence
  Description of Artificial Sequence: Synthetic oligonucleotide
gggaggacgaugcgguucguacuuuuuuuuuccgcagacgacucgcccga

SEQ ID NO: 11780 - RNA, 51 nt, Artificial Sequence
  Description of Artificial Sequence: Synthetic oligonucleotide
gggaggacgaugcggaaucauuucuucuuccaccgcagacgacucgcccga

SEQ ID NO: 11781 - RNA, 51 nt, Artificial Sequence
  Description of Artificial Sequence: Synthetic oligonucleotide
gggaggacgaugcgguuuuucacuuucacuugcugcagacgacucgcccga

SEQ ID NO: 11782 - RNA, 51 nt, Artificial Sequence
  Description of Artificial Sequence: Synthetic oligonucleotide
gggaggacgaugcgguuuauuuacuuuucccucgccagacgacucgcccga

SEQ ID NO: 11783 - RNA, 51 nt, Artificial Sequence
  Description of Artificial Sequence: Synthetic oligonucleotide
gggaggacgaugcggcuuuacauuaucucuuuccgcagacgacucgcccga

SEQ ID NO: 11784 - RNA, 51 nt, Artificial Sequence
  Description of Artificial Sequence: Synthetic oligonucleotide
gggaggacgaugcggucucuuuaaaauucucuccgcagacgacucgcccga

SEQ ID NO: 11785 - RNA, 51 nt, Artificial Sequence
  Description of Artificial Sequence: Synthetic oligonucleotide
gggaggacgaugcggucuuucuuuuacccuauccgcagacgacucgcccga

SEQ ID NO: 11786 - RNA, 51 nt, Artificial Sequence
  Description of Artificial Sequence: Synthetic oligonucleotide
gggaggacgaugcggguuuuauuuguuguguuccccagacgacucgcccga

SEQ ID NO: 11787 - RNA, 51 nt, Artificial Sequence
  Description of Artificial Sequence: Synthetic oligonucleotide
gggaggacgaugcggccuuuauuucuuauucuccgcagacgacucgcccga

SEQ ID NO: 11788 - RNA, 51 nt, Artificial Sequence
  Description of Artificial Sequence: Synthetic oligonucleotide
gggaggacgaugcggcuuuuuucuuuuucauuccgcagacgacucgcccga

SEQ ID NO: 11789 - RNA, 51 nt, Artificial Sequence
  Description of Artificial Sequence: Synthetic oligonucleotide
gggaggacgaugcggucuuauucuuuuuuccucugcagacgacucgcccga

SEQ ID NO: 11790 - RNA, 51 nt, Artificial Sequence
  Description of Artificial Sequence: Synthetic oligonucleotide
gggaggacgaugcggaucuuuucugucuuuucccgcagacgacucgcccga

SEQ ID NO: 11791 - RNA, 51 nt, Artificial Sequence
  Description of Artificial Sequence: Synthetic oligonucleotide
gggaggacgaugcgguuuguuguguucuuuauccgcagacgacucgcccga

SEQ ID NO: 11792 - RNA, 51 nt, Artificial Sequence
  Description of Artificial Sequence: Synthetic oligonucleotide
gggaggacgaugcgguuuguccuuguuuuuguccgcagacgacucgcccga

SEQ ID NO: 11793 - RNA, 51 nt, Artificial Sequence
  Description of Artificial Sequence: Synthetic oligonucleotide
gggaggacgaugcgguauuuuugcuuuccuguccgcagacgacucgcccga

SEQ ID NO: 11794 - RNA, 51 nt, Artificial Sequence
  Description of Artificial Sequence: Synthetic oligonucleotide
gggaggacgaugcgguuuugcuuaucuucuguccgcagacgacucgcccga

SEQ ID NO: 11795 - RNA, 51 nt, Artificial Sequence
  Description of Artificial Sequence: Synthetic oligonucleotide
gggaggacgaugcgggauacuuuuuuuuuugcccccagacgacucgcccga

SEQ ID NO: 11796 - RNA, 51 nt, Artificial Sequence
  Description of Artificial Sequence: Synthetic oligonucleotide
gggaggacgaugcggccuacuuugucucuuuuccgcagacgacucgcccga

SEQ ID NO: 11797 - RNA, 51 nt, Artificial Sequence
  Description of Artificial Sequence: Synthetic oligonucleotide
gggaggacgaugcggguuuuuugaucucuuguccccagacgacucgcccga

SEQ ID NO: 11798 - RNA, 51 nt, Artificial Sequence
  Description of Artificial Sequence: Synthetic oligonucleotide
gggaggacgaugcggucuucuuuuucuguucuccgcagacgacucgcccga

SEQ ID NO: 11799 - RNA, 52 nt, Artificial Sequence
  Description of Artificial Sequence: Synthetic oligonucleotide
gggaggacgaugcggguuuuuauuuccacuguuccccagacgacucgcccga

SEQ ID NO: 11800 - RNA, 51 nt, Artificial Sequence
  Description of Artificial Sequence: Synthetic oligonucleotide
gggaggacgaugcgguuuauuuuacuguuucuccgcagacgacucgcccga

SEQ ID NO: 11801 - RNA, 51 nt, Artificial Sequence
  Description of Artificial Sequence: Synthetic oligonucleotide
gggaggacgaugcgguuugguuuuuuuuuugcccgcagacgacucgcccga

SEQ ID NO: 11802 - RNA, 52 nt, Artificial Sequence
  Description of Artificial Sequence: Synthetic oligonucleotide
gggaggacgaugcgguuuccacgguuuuuuuuuccgcagacgacucgcccga

SEQ ID NO: 11803 - RNA, 51 nt, Artificial Sequence
  Description of Artificial Sequence: Synthetic oligonucleotide
gggaggacgaugcggauuucuucucuuauuucccgcagacgacucgcccga

SEQ ID NO: 11804 - RNA, 51 nt, Artificial Sequence
  Description of Artificial Sequence: Synthetic oligonucleotide
gggaggacgaugcgguauuuugauuuacuuuuccccagacgacucgcccga

SEQ ID NO: 11805 - RNA, 51 nt, Artificial Sequence
  Description of Artificial Sequence: Synthetic oligonucleotide
gggaggacgaugcggguucuuucauguuuuuuccccagacgacucgcccga

SEQ ID NO: 11806 - RNA, 51 nt, Artificial Sequence
  Description of Artificial Sequence: Synthetic oligonucleotide
gggaggacgaugcggguuuguucuuuuuuuuuccgcagacgacucgcccga

SEQ ID NO: 11807 - RNA, 51 nt, Artificial Sequence
  Description of Artificial Sequence: Synthetic oligonucleotide
gggaggacgaugcgguauuuacguuuuuuuuugugcagacgacucgcccga

SEQ ID NO: 11808 - RNA, 51 nt, Artificial Sequence
  Description of Artificial Sequence: Synthetic oligonucleotide
gggaggacgaugcggaaggaggugguguuauggugcagacgacucgcccga

SEQ ID NO: 11809 - RNA, 51 nt, Artificial Sequence
  Description of Artificial Sequence: Synthetic oligonucleotide
gggaggacgaugcgguuaucaccuuucuucuuccgcagacgacucgcccga

SEQ ID NO: 11810 - RNA, 51 nt, Artificial Sequence
  Description of Artificial Sequence: Synthetic oligonucleotide
gggaggacgaugcgguuuucuuggucuucuugccgcagacgacucgcccga

SEQ ID NO: 11811 - RNA, 51 nt, Artificial Sequence
  Description of Artificial Sequence: Synthetic oligonucleotide
gggaggacgaugcggugcuucuuuuucuuuccccgcagacgacucgcccga

SEQ ID NO: 11812 - RNA, 51 nt, Artificial Sequence
  Description of Artificial Sequence: Synthetic oligonucleotide
gggaggacgaugcgguuuucauuucucuuuuaccccagacgacucgcccga

SEQ ID NO: 11813 - RNA, 51 nt, Artificial Sequence
  Description of Artificial Sequence: Synthetic oligonucleotide
gggaggacgaugcggcuucucgucuuuucuuaccgcagacgacucgcccga

SEQ ID NO: 11814 - RNA, 51 nt, Artificial Sequence
  Description of Artificial Sequence: Synthetic oligonucleotide
gggaggacgaugcgguuuuucaguguuuuugugugcagacgacucgcccga

SEQ ID NO: 11815 - RNA, 51 nt, Artificial Sequence
  Description of Artificial Sequence: Synthetic oligonucleotide
gggaggacgaugcggguuuacuuuuucccuuuucccagacgacucgcccga

SEQ ID NO: 11816 - RNA, 51 nt, Artificial Sequence
  Description of Artificial Sequence: Synthetic oligonucleotide
gggaggacgaugcggcuucucuuacuuuucuuccgcagacgacucgcccga

SEQ ID NO: 11817 - RNA, 51 nt, Artificial Sequence
  Description of Artificial Sequence: Synthetic oligonucleotide
gggaggacgaugcggcuuuuguuucuucuuucccgcagacgacucgcccga

SEQ ID NO: 11818 - RNA, 51 nt, Artificial Sequence
  Description of Artificial Sequence: Synthetic oligonucleotide
gggaggacgaugcgguuuucuuuucuuguuuugcgcagacgacucgcccga

SEQ ID NO: 11819 - RNA, 51 nt, Artificial Sequence
  Description of Artificial Sequence: Synthetic oligonucleotide
gggaggacgaugcggauuuuauuuugucuuuaccgcagacgacucgcccga

SEQ ID NO: 11820 - RNA, 51 nt, Artificial Sequence
  Description of Artificial Sequence: Synthetic oligonucleotide
gggaggacgaugcgguuuuugcuucuuuuuuugcgcagacgacucgcccga

SEQ ID NO: 11821 - RNA, 51 nt, Artificial Sequence
  Description of Artificial Sequence: Synthetic oligonucleotide
gggaggacgaugcgguauuaucuuuuauucuugugcagacgacucgcccga

SEQ ID NO: 11822 - RNA, 50 nt, Artificial Sequence
  Description of Artificial Sequence: Synthetic oligonucleotide
gggaggacgaugcggauucucuuucuuuucaccgcagacgacucgcccga

SEQ ID NO: 11823 - RNA, 51 nt, Artificial Sequence
  Description of Artificial Sequence: Synthetic oligonucleotide
gggaggacgaugcgguacuuuccccuuuuucuccgcagacgacucgcccga

SEQ ID NO: 11824 - RNA, 51 nt, Artificial Sequence
  Description of Artificial Sequence: Synthetic oligonucleotide
gggaggacgaugcggaguuucguguuuuuuugccccagacgacucgcccga

SEQ ID NO: 11825 - RNA, 51 nt, Artificial Sequence
  Description of Artificial Sequence: Synthetic oligonucleotide
gggaggacgaugcgguuauucuucgccuuucuccgcagacgacucgcccga

SEQ ID NO: 11826 - RNA, 51 nt, Artificial Sequence
  Description of Artificial Sequence: Synthetic oligonucleotide
gggaggacgaugcgguuuauuccacuuucuucccgcagacgacucgcccga

SEQ ID NO: 11827 - RNA, 51 nt, Artificial Sequence
  Description of Artificial Sequence: Synthetic oligonucleotide
gggaggacgaugcgguuuggguguaggguguuccgcagacgacucgcccga

SEQ ID NO: 11828 - RNA, 52 nt, Artificial Sequence
  Description of Artificial Sequence: Synthetic oligonucleotide
gggaggacgaugcggcuuuucucuuuuuuuccgcgccagacgacucgcccga

SEQ ID NO: 11829 - RNA, 51 nt, Artificial Sequence
  Description of Artificial Sequence: Synthetic oligonucleotide
gggaggacgaugcggauuuuugcucuuuccuuccgcagacgacucgcccga

SEQ ID NO: 11830 - RNA, 51 nt, Artificial Sequence
  Description of Artificial Sequence: Synthetic oligonucleotide
gggaggacgaugcggcuuucuuuauuucccuuccgcagacgacucgcccga

SEQ ID NO: 11831 - RNA, 51 nt, Artificial Sequence
  Description of Artificial Sequence: Synthetic oligonucleotide
gggaggacgaugcgguacuuucgcuuuucuuuccgcagacgacucgcccga

SEQ ID NO: 11832 - RNA, 51 nt, Artificial Sequence
  Description of Artificial Sequence: Synthetic oligonucleotide
gggaggacgaugcggccuuuucguuuccuuauccgcagacgacucgcccga

SEQ ID NO: 11833 - RNA, 51 nt, Artificial Sequence
  Description of Artificial Sequence: Synthetic oligonucleotide
gggaggacgaugcgguuuuuauacguuuugcuccgcagacgacucgcccga

SEQ ID NO: 11834 - RNA, 51 nt, Artificial Sequence
  Description of Artificial Sequence: Synthetic oligonucleotide
gggaggacgaugcgguuucacugcuuccuuuuccgcagacgacucgcccga

SEQ ID NO: 11835 - RNA, 51 nt, Artificial Sequence
  Description of Artificial Sequence: Synthetic oligonucleotide
gggaggacgaugcggguuugcuuuucucuuuuccgcagacgacucgcccga

SEQ ID NO: 11836 - RNA, 51 nt, Artificial Sequence
  Description of Artificial Sequence: Synthetic oligonucleotide
gggaggacgaugcggccuuuacucauucuuuuccgcagacgacucgcccga

SEQ ID NO: 11837 - RNA, 52 nt, Artificial Sequence
  Description of Artificial Sequence: Synthetic oligonucleotide
gggaggacgaugcgguuuucauuguuucauuuucugcagacgacucgcccga

SEQ ID NO: 11838 - RNA, 51 nt, Artificial Sequence
  Description of Artificial Sequence: Synthetic oligonucleotide
gggaggacgaugcggucuuuuuuuguguuucuccgcagacgacucgcccga

SEQ ID NO: 11839 - RNA, 51 nt, Artificial Sequence
  Description of Artificial Sequence: Synthetic oligonucleotide
gggaggacgaugcgguuguuuuauuuuauuugccccagacgacucgcccga

SEQ ID NO: 11840 - RNA, 52 nt, Artificial Sequence
  Description of Artificial Sequence: Synthetic oligonucleotide
gggaggacgaugcgguuaccuuuugauuuuuuuccccagacgacucgcccga

SEQ ID NO: 11841 - RNA, 51 nt, Artificial Sequence
  Description of Artificial Sequence: Synthetic oligonucleotide
gggaggacgaugcggguuaccuuuuccuuuuuccccagacgacucgcccga

SEQ ID NO: 11842 - RNA, 51 nt, Artificial Sequence
  Description of Artificial Sequence: Synthetic oligonucleotide
gggaggacgaugcggguuuucucauucucuuaccgcagacgacucgcccga

SEQ ID NO: 11843 - RNA, 51 nt, Artificial Sequence
  Description of Artificial Sequence: Synthetic oligonucleotide
gggaggacgaugcggauuuuccucuuuacuugccgcagacgacucgcccga

SEQ ID NO: 11844 - RNA, 51 nt, Artificial Sequence
  Description of Artificial Sequence: Synthetic oligonucleotide
gggaggacgaugcggauuuuucuucucuuaccccgcagacgacucgcccga

SEQ ID NO: 11845 - RNA, 51 nt, Artificial Sequence
  Description of Artificial Sequence: Synthetic oligonucleotide
gggaggacgaugcggccuuuuacuuccuuuucccgcagacgacucgcccga

SEQ ID NO: 11846 - RNA, 51 nt, Artificial Sequence
  Description of Artificial Sequence: Synthetic oligonucleotide
gggaggacgaugcggaauuuuauuuuguuguaccgcagacgacucgcccga

SEQ ID NO: 11847 - RNA, 51 nt, Artificial Sequence
  Description of Artificial Sequence: Synthetic oligonucleotide
gggaggacgaugcgguucuuugacuauuuacuccgcagacgacucgcccga

SEQ ID NO: 11848 - RNA, 52 nt, Artificial Sequence
  Description of Artificial Sequence: Synthetic oligonucleotide
gggaggacgaugcgguuuucguuuuuuuuugcgccgcagacgacucgcccga

SEQ ID NO: 11849 - RNA, 50 nt, Artificial Sequence
  Description of Artificial Sequence: Synthetic oligonucleotide
gggaggacgaugcgguuuuucuuuccuuuguccgcagacgacucgcccga

SEQ ID NO: 11850 - RNA, 51 nt, Artificial Sequence
  Description of Artificial Sequence: Synthetic oligonucleotide
gggaggacgaugcggauguuuucuucauuuuaccgcagacgacucgcccga

SEQ ID NO: 11851 - RNA, 51 nt, Artificial Sequence
  Description of Artificial Sequence: Synthetic oligonucleotide
gggaggacgaugcggcuauucaacuucuuuuuccgcagacgacucgcccga

SEQ ID NO: 11852 - RNA, 50 nt, Artificial Sequence
  Description of Artificial Sequence: Synthetic oligonucleotide
gggaggacgaugcgguuuguuuauucuuuuuccgcagacgacucgcccga

SEQ ID NO: 11853 - RNA, 51 nt, Artificial Sequence
  Description of Artificial Sequence: Synthetic oligonucleotide
gggaggacgaugcgguuucuuuguguuuuuauccccagacgacucgcccga

SEQ ID NO: 11854 - RNA, 51 nt, Artificial Sequence
  Description of Artificial Sequence: Synthetic oligonucleotide
gggaggacgaugcggauuucacuacuacuuuaccgcagacgacucgcccga

SEQ ID NO: 11855 - RNA, 51 nt, Artificial Sequence
  Description of Artificial Sequence: Synthetic oligonucleotide
gggaggacgaugcgguuuucuuuguuucucgcccgcagacgacucgcccga

SEQ ID NO: 11856 - RNA, 51 nt, Artificial Sequence
  Description of Artificial Sequence: Synthetic oligonucleotide
gggaggacgaugcgguucguacuuuuuuuuuuccgcagacgacucgcccga

SEQ ID NO: 11857 - RNA, 52 nt, Artificial Sequence
  Description of Artificial Sequence: Synthetic oligonucleotide
gggaggacgaugcggaauuucucguuuuuuuugcugcagacgacucgcccga

SEQ ID NO: 11858 - RNA, 51 nt, Artificial Sequence
  Description of Artificial Sequence: Synthetic oligonucleotide
gggaggacgaugcgguuaucuuuuacucuauuccgcagacgacucgcccga

SEQ ID NO: 11859 - RNA, 52 nt, Artificial Sequence
  Description of Artificial Sequence: Synthetic oligonucleotide
gggaggacgaugcgguuuuagcuucuuuuuuguccgcagacgacucgcccga

SEQ ID NO: 11860 - RNA, 53 nt, Artificial Sequence
  Description of Artificial Sequence: Synthetic oligonucleotide
gggaggacgaugcggguuuuguuuuuuuuccuuuccgcagacgacucgcccga

SEQ ID NO: 11861 - RNA, 51 nt, Artificial Sequence
  Description of Artificial Sequence: Synthetic oligonucleotide
gggaggacgaugcgguuuuuucuaauuucuccccgcagacgacucgcccga

SEQ ID NO: 11862 - RNA, 51 nt, Artificial Sequence
  Description of Artificial Sequence: Synthetic oligonucleotide
gggaggacgaugcggaguucuuuauuuucuuuccccagacgacucgcccga

SEQ ID NO: 11863 - RNA, 51 nt, Artificial Sequence
  Description of Artificial Sequence: Synthetic oligonucleotide
gggaggacgaugcggccuuauuuauuuuccuuccgcagacgacucgcccga

SEQ ID NO: 11864 - RNA, 51 nt, Artificial Sequence
  Description of Artificial Sequence: Synthetic oligonucleotide
gggaggacgaugcgguucgggguuuucccgugccccagacgacucgcccga

SEQ ID NO: 11865 - RNA, 49 nt, Artificial Sequence
  Description of Artificial Sequence: Synthetic oligonucleotide
gggaggacgaugcgguccucgucuguucguccccagacgacucgcccga

SEQ ID NO: 11866 - RNA, 51 nt, Artificial Sequence
  Description of Artificial Sequence: Synthetic oligonucleotide
gggaggacgaugcgguuaggugaagggugguuccgcagacgacucgcccga

SEQ ID NO: 11867 - RNA, 51 nt, Artificial Sequence
  Description of Artificial Sequence: Synthetic oligonucleotide
gggaggacgaugcggauucuuuauaucccuuaccgcagacgacucgcccga

SEQ ID NO: 11868 - RNA, 51 nt, Artificial Sequence
  Description of Artificial Sequence: Synthetic oligonucleotide
gggaggacgaugcgggcucuauuccuucuuuuccgcagacgacucgcccga

SEQ ID NO: 11869 - RNA, 51 nt, Artificial Sequence
  Description of Artificial Sequence: Synthetic oligonucleotide
gggaggacgaugcgguuucuaugucguuuuguccgcagacgacucgcccga

SEQ ID NO: 11870 - RNA, 51 nt, Artificial Sequence
  Description of Artificial Sequence: Synthetic oligonucleotide
gggaggacgaugcggguuacucuuuuccgcuuccgcagacgacucgcccga

SEQ ID NO: 11871 - RNA, 51 nt, Artificial Sequence
  Description of Artificial Sequence: Synthetic oligonucleotide
gggaggacgaugcggaugcuuggaguaggggggugcagacgacucgcccga

SEQ ID NO: 11872 - RNA, 51 nt, Artificial Sequence
  Description of Artificial Sequence: Synthetic oligonucleotide
gggaggacgaugcgguuauuucuccuucgcuuccgcagacgacucgcccga

SEQ ID NO: 11873 - RNA, 51 nt, Artificial Sequence
  Description of Artificial Sequence: Synthetic oligonucleotide
gggaggacgaugcgguuucuuuucaccuuuacccgcagacgacucgcccga

SEQ ID NO: 11874 - RNA, 51 nt, Artificial Sequence
  Description of Artificial Sequence: Synthetic oligonucleotide
gggaggacgaugcgguuuacucuagcuuuucuccgcagacgacucgcccga

SEQ ID NO: 11875 - RNA, 50 nt, Artificial Sequence
  Description of Artificial Sequence: Synthetic oligonucleotide
gggaggacgaugcggguuuucucucuucuuugcccagacgacucgcccga

SEQ ID NO: 11876 - RNA, 51 nt, Artificial Sequence
  Description of Artificial Sequence: Synthetic oligonucleotide
gggaggacgaugcggagcuuuucucuuucuuuccgcagacgacucgcccga

SEQ ID NO: 11877 - RNA, 51 nt, Artificial Sequence
  Description of Artificial Sequence: Synthetic oligonucleotide
gggaggacgaugcggcuuuaaacuuuucuuuuccgcagacgacucgcccga

SEQ ID NO: 11878 - RNA, 51 nt, Artificial Sequence
  Description of Artificial Sequence: Synthetic oligonucleotide
gggaggacgaugcggccuauuauucauuuucuccgcagacgacucgcccga

SEQ ID NO: 11879 - RNA, 51 nt, Artificial Sequence
  Description of Artificial Sequence: Synthetic oligonucleotide
gggaggacgaugcggcucacuucuuucuuauuccgcagacgacucgcccga

SEQ ID NO: 11880 - RNA, 51 nt, Artificial Sequence
  Description of Artificial Sequence: Synthetic oligonucleotide
gggaggacgaugcggaucuuucauucuucuucccgcagacgacucgcccga

SEQ ID NO: 11881 - RNA, 51 nt, Artificial Sequence
  Description of Artificial Sequence: Synthetic oligonucleotide
gggaggacgaugcgguuauuuauuuguucuuugcccagacgacucgcccga

SEQ ID NO: 11882 - RNA, 51 nt, Artificial Sequence
  Description of Artificial Sequence: Synthetic oligonucleotide
gggaggacgaugcgguuuuacuuucuuacuuugcccagacgacucgcccga

SEQ ID NO: 11883 - RNA, 51 nt, Artificial Sequence
  Description of Artificial Sequence: Synthetic oligonucleotide
gggaggacgaugcgguuuauuuuugacuuuuuccgcagacgacucgcccga

SEQ ID NO: 11884 - RNA, 51 nt, Artificial Sequence
  Description of Artificial Sequence: Synthetic oligonucleotide
gggaggacgaugcgguucuauuuuuucuucuuccgcagacgacucgcccga

SEQ ID NO: 11885 - RNA, 51 nt, Artificial Sequence
  Description of Artificial Sequence: Synthetic oligonucleotide
gggaggacgaugcgguuuuauuucuucuuuuucgccagacgacucgcccga

SEQ ID NO: 11886 - RNA, 51 nt, Artificial Sequence
  Description of Artificial Sequence: Synthetic oligonucleotide
gggaggacgaugcgguuguuuauuuucucuuugcgcagacgacucgcccga

SEQ ID NO: 11887 - RNA, 51 nt, Artificial Sequence
  Description of Artificial Sequence: Synthetic oligonucleotide
gggaggacgaugcgggaucucuuuuccucuacccgcagacgacucgcccga

SEQ ID NO: 11888 - RNA, 51 nt, Artificial Sequence
  Description of Artificial Sequence: Synthetic oligonucleotide
gggaggacgaugcggauuuucucucuucugccccgcagacgacucgcccga

SEQ ID NO: 11889 - RNA, 51 nt, Artificial Sequence
  Description of Artificial Sequence: Synthetic oligonucleotide
gggaggacgaugcggaguggagaagggaggugcugcagacgacucgcccga

SEQ ID NO: 11890 - RNA, 49 nt, Artificial Sequence
  Description of Artificial Sequence: Synthetic oligonucleotide
gggaggacgaugcgguucuugucuuucuuuccgcagacgacucgcccga

SEQ ID NO: 11891 - RNA, 50 nt, Artificial Sequence
  Description of Artificial Sequence: Synthetic oligonucleotide
gggaggacgaugcgguaguguuuuuuuuugugcccagacgacucgcccga

SEQ ID NO: 11892 - RNA, 51 nt, Artificial Sequence
  Description of Artificial Sequence: Synthetic oligonucleotide
gggaggacgaugcggucuuuacgcuuucuucuccgcagacgacucgcccga

SEQ ID NO: 11893 - RNA, 51 nt, Artificial Sequence
  Description of Artificial Sequence: Synthetic oligonucleotide
gggaggacgaugcgguuuuucaugaacccuuuccgcagacgacucgcccga

SEQ ID NO: 11894 - RNA, 51 nt, Artificial Sequence
  Description of Artificial Sequence: Synthetic oligonucleotide
gggaggacgaugcggacucuuuaucguuuuuuccgcagacgacucgcccga

SEQ ID NO: 11895 - RNA, 51 nt, Artificial Sequence
  Description of Artificial Sequence: Synthetic oligonucleotide
gggaggacgaugcggccuuuuuuucuuuuccaccgcagacgacucgcccga

SEQ ID NO: 11896 - RNA, 51 nt, Artificial Sequence
  Description of Artificial Sequence: Synthetic oligonucleotide
gggaggacgaugcgguuuuugucgcuuuauucccgcagacgacucgcccga

SEQ ID NO: 11897 - RNA, 51 nt, Artificial Sequence
  Description of Artificial Sequence: Synthetic oligonucleotide
gggaggacgaugcgguuuuuucacuuuucccucugcagacgacucgcccga

SEQ ID NO: 11898 - RNA, 51 nt, Artificial Sequence
  Description of Artificial Sequence: Synthetic oligonucleotide
gggaggacgaugcgguuacucuuucuauuuccccccagacgacucgcccga

SEQ ID NO: 11899 - RNA, 51 nt, Artificial Sequence
  Description of Artificial Sequence: Synthetic oligonucleotide
gggaggacgaugcggauuuuuauguguuguuugugcagacgacucgcccga

SEQ ID NO: 11900 - RNA, 51 nt, Artificial Sequence
  Description of Artificial Sequence: Synthetic oligonucleotide
gggaggacgaugcggauucuuaauuucuuugcccgcagacgacucgcccga

SEQ ID NO: 11901 - RNA, 51 nt, Artificial Sequence
  Description of Artificial Sequence: Synthetic oligonucleotide
gggaggacgaugcggucuauuuuauuugcuuuccgcagacgacucgcccga

SEQ ID NO: 11902 - RNA, 51 nt, Artificial Sequence
  Description of Artificial Sequence: Synthetic oligonucleotide
gggaggacgaugcgguuuucuuucauccugguccgcagacgacucgcccga

SEQ ID NO: 11903 - RNA, 51 nt, Artificial Sequence
  Description of Artificial Sequence: Synthetic oligonucleotide
gggaggacgaugcggaccuuuuguuuucuauuccgcagacgacucgcccga

SEQ ID NO: 11904 - RNA, 51 nt, Artificial Sequence
  Description of Artificial Sequence: Synthetic oligonucleotide
gggaggacgaugcggauuuugcucuuuuucuuccgcagacgacucgcccga

SEQ ID NO: 11905 - RNA, 51 nt, Artificial Sequence
  Description of Artificial Sequence: Synthetic oligonucleotide
gggaggacgaugcgguuuuugucuacuuuuuccgccagacgacucgcccga

SEQ ID NO: 11906 - RNA, 51 nt, Artificial Sequence
  Description of Artificial Sequence: Synthetic oligonucleotide
gggaggacgaugcggaucuuucuaaauuuucaccgcagacgacucgcccga

SEQ ID NO: 11907 - RNA, 51 nt, Artificial Sequence
  Description of Artificial Sequence: Synthetic oligonucleotide
gggaggacgaugcggucuuuuuuccuauuucuccgcagacgacucgcccga

SEQ ID NO: 11908 - RNA, 51 nt, Artificial Sequence
  Description of Artificial Sequence: Synthetic oligonucleotide
gggaggacgaugcgguuuucauuaucuuuuuccgccagacgacucgcccga

SEQ ID NO: 11909 - RNA, 52 nt, Artificial Sequence
  Description of Artificial Sequence: Synthetic oligonucleotide
gggaggacgaugcgguuuguuuuucuuuuuuucgcccagacgacucgcccga

SEQ ID NO: 11910 - RNA, 52 nt, Artificial Sequence
  Description of Artificial Sequence: Synthetic oligonucleotide
gggaggacgaugcgguccauguuguuuuuuuuuccgcagacgacucgcccga

SEQ ID NO: 11911 - RNA, 52 nt, Artificial Sequence
  Description of Artificial Sequence: Synthetic oligonucleotide
gggaggacgaugcgguauuuacguuuuuuuuuugugcagacgacucgcccga

SEQ ID NO: 11912 - RNA, 52 nt, Artificial Sequence
  Description of Artificial Sequence: Synthetic oligonucleotide
gggaggacgaugcggucuuuuuuuucacuuucuccgcagacgacucgcccga

SEQ ID NO: 11913 - RNA, 51 nt, Artificial Sequence
  Description of Artificial Sequence: Synthetic oligonucleotide
gggaggacgaugcgguuuccuuuuuaucuuuuccccagacgacucgcccga

SEQ ID NO: 11914 - RNA, 51 nt, Artificial Sequence
  Description of Artificial Sequence: Synthetic oligonucleotide
gggaggacgaugcgguuuuuauguuuuuuuccgugcagacgacucgcccga

SEQ ID NO: 11915 - RNA, 51 nt, Artificial Sequence
  Description of Artificial Sequence: Synthetic oligonucleotide
gggaggacgaugcgguguuauuuuuguuucuuguccagacgacucgcccga

SEQ ID NO: 11916 - RNA, 52 nt, Artificial Sequence
  Description of Artificial Sequence: Synthetic oligonucleotide
gggaggacgaugcggcaucacuuuuucuuuacaccgcagacgacucgcccga

SEQ ID NO: 11917 - RNA, 51 nt, Artificial Sequence
  Description of Artificial Sequence: Synthetic oligonucleotide
gggaggacgaugcggaucuuuuuguucgcuuuccgcagacgacucgcccga

SEQ ID NO: 11918 - RNA, 51 nt, Artificial Sequence
  Description of Artificial Sequence: Synthetic oligonucleotide
gggaggacgaugcggccuuucuucuuuuccuugcccagacgacucgcccga

SEQ ID NO: 11919 - RNA, 51 nt, Artificial Sequence
  Description of Artificial Sequence: Synthetic oligonucleotide
gggaggacgaugcggauuuguuccauuuuccaccgcagacgacucgcccga

SEQ ID NO: 11920 - RNA, 51 nt, Artificial Sequence
  Description of Artificial Sequence: Synthetic oligonucleotide
gggaggacgaugcgguacucuucuuuuuaucgccgcagacgacucgcccga

SEQ ID NO: 11921 - RNA, 51 nt, Artificial Sequence
  Description of Artificial Sequence: Synthetic oligonucleotide
gggaggacgaugcggauccugucuuauuuucuccgcagacgacucgcccga

SEQ ID NO: 11922 - RNA, 51 nt, Artificial Sequence
  Description of Artificial Sequence: Synthetic oligonucleotide
gggaggacgaugcgguuuucacauuauuuccccgccagacgacucgcccga

SEQ ID NO: 11923 - RNA, 52 nt, Artificial Sequence
  Description of Artificial Sequence: Synthetic oligonucleotide
gggaggacgaugcggcuuuuuuucccuuguuguugccagacgacucgcccga

SEQ ID NO: 11924 - RNA, 51 nt, Artificial Sequence
  Description of Artificial Sequence: Synthetic oligonucleotide
gggaggacgaugcggucuuuacucauauuuuuccgcagacgacucgcccga

SEQ ID NO: 11925 - RNA, 51 nt, Artificial Sequence
  Description of Artificial Sequence: Synthetic oligonucleotide
gggaggacgaugcgguucuuuguuuaccuuucccgcagacgacucgcccga

SEQ ID NO: 11926 - RNA, 51 nt, Artificial Sequence
  Description of Artificial Sequence: Synthetic oligonucleotide
gggaggacgaugcgguuuuuuccuuuauuuuugcccagacgacucgcccga

SEQ ID NO: 11927 - RNA, 51 nt, Artificial Sequence
  Description of Artificial Sequence: Synthetic oligonucleotide
gggaggacgaugcgguuaggugaagggugguuucgcagacgacucgcccga

SEQ ID NO: 11928 - RNA, 51 nt, Artificial Sequence
  Description of Artificial Sequence: Synthetic oligonucleotide
gggaggacgaugcggacuuuuucuuuuuuucccugcagacgacucgcccga

SEQ ID NO: 11929 - RNA, 51 nt, Artificial Sequence
  Description of Artificial Sequence: Synthetic oligonucleotide
gggaggacgaugcgguuuuuuacuucucuucgcugcagacgacucgcccga

SEQ ID NO: 11930 - RNA, 51 nt, Artificial Sequence
  Description of Artificial Sequence: Synthetic oligonucleotide
gggaggacgaugcgguuauuuacuuuuuuucucugcagacgacucgcccga

SEQ ID NO: 11931 - RNA, 52 nt, Artificial Sequence
  Description of Artificial Sequence: Synthetic oligonucleotide
gggaggacgaugcgguuuauucuguuuuuuuuuccgcagacgacucgcccga

SEQ ID NO: 11932 - RNA, 51 nt, Artificial Sequence
  Description of Artificial Sequence: Synthetic oligonucleotide
gggaggacgaugcggcuuuucuauacauuuuuccgcagacgacucgcccga

SEQ ID NO: 11933 - RNA, 51 nt, Artificial Sequence
  Description of Artificial Sequence: Synthetic oligonucleotide
gggaggacgaugcgguuaucuuacguuuuucucugcagacgacucgcccga

SEQ ID NO: 11934 - RNA, 51 nt, Artificial Sequence
  Description of Artificial Sequence: Synthetic oligonucleotide
gggaggacgaugcgguuuguguuuuuuauuuucugcagacgacucgcccga

SEQ ID NO: 11935 - RNA, 51 nt, Artificial Sequence
  Description of Artificial Sequence: Synthetic oligonucleotide
gggaggacgaugcggacacuuuucuuuucuuuccccagacgacucgcccga

SEQ ID NO: 11936 - RNA, 51 nt, Artificial Sequence
  Description of Artificial Sequence: Synthetic oligonucleotide
gggaggacgaugcggcuuuuauguuucccguuccgcagacgacucgcccga

SEQ ID NO: 11937 - RNA, 52 nt, Artificial Sequence
  Description of Artificial Sequence: Synthetic oligonucleotide
gggaggacgaugcggauuuuuugacuguuuccuccgcagacgacucgcccga

SEQ ID NO: 11938 - RNA, 50 nt, Artificial Sequence
  Description of Artificial Sequence: Synthetic oligonucleotide
gggaggacgaugcgguucuuuucuuucuucuccgcagacgacucgcccga

SEQ ID NO: 11939 - RNA, 51 nt, Artificial Sequence
  Description of Artificial Sequence: Synthetic oligonucleotide
gggaggacgaugcggacuucuauugcuccuuuccgcagacgacucgcccga

SEQ ID NO: 11940 - RNA, 50 nt, Artificial Sequence
  Description of Artificial Sequence: Synthetic oligonucleotide
gggaggacgaugcggguuuguuucuuuguuaccgcagacgacucgcccga

SEQ ID NO: 11941 - RNA, 51 nt, Artificial Sequence
  Description of Artificial Sequence: Synthetic oligonucleotide
gggaggacgaugcggacuuucacuuacucucaccgcagacgacucgcccga

SEQ ID NO: 11942 - RNA, 51 nt, Artificial Sequence
  Description of Artificial Sequence: Synthetic oligonucleotide
gggaggacgaugcgggaauuauccugcauucaccgcagacgacucgcccga

SEQ ID NO: 11943 - RNA, 51 nt, Artificial Sequence
  Description of Artificial Sequence: Synthetic oligonucleotide
gggaggacgaugcggugcuuuggaguaggggggugcagacgacucgcccga

SEQ ID NO: 11944 - RNA, 51 nt, Artificial Sequence
  Description of Artificial Sequence: Synthetic oligonucleotide
gggaggacgaugcgguuauuuuuguuucucuuccgcagacgacucgcccga

SEQ ID NO: 11945 - RNA, 51 nt, Artificial Sequence
  Description of Artificial Sequence: Synthetic oligonucleotide
gggaggacgaugcggauuucaauuugcuuucaccgcagacgacucgcccga

SEQ ID NO: 11946 - RNA, 51 nt, Artificial Sequence
  Description of Artificial Sequence: Synthetic oligonucleotide
gggaggacgaugcgguucuuuucucuuuaacuccgcagacgacucgcccga

SEQ ID NO: 11947 - RNA, 51 nt, Artificial Sequence
  Description of Artificial Sequence: Synthetic oligonucleotide
gggaggacgaugcggcauucuuuucuuuuucgcugcagacgacucgcccga

SEQ ID NO: 11948 - RNA, 51 nt, Artificial Sequence
  Description of Artificial Sequence: Synthetic oligonucleotide
gggaggacgaugcgguuauuacuuuauucuguccgcagacgacucgcccga

SEQ ID NO: 11949 - RNA, 52 nt, Artificial Sequence
  Description of Artificial Sequence: Synthetic oligonucleotide
gggaggacgaugcggcauaucuuuucauuuucaccgcagacgacucgcccga

SEQ ID NO: 11950 - RNA, 51 nt, Artificial Sequence
  Description of Artificial Sequence: Synthetic oligonucleotide
gggaggacgaugcgguuuuucauaccuuuauuccgcagacgacucgcccga

SEQ ID NO: 11951 - RNA, 50 nt, Artificial Sequence
  Description of Artificial Sequence: Synthetic oligonucleotide
gggaggacgaugcgguuucaucuuuuuuuuuccgcagacgacucgcccga

SEQ ID NO: 11952 - RNA, 51 nt, Artificial Sequence
  Description of Artificial Sequence: Synthetic oligonucleotide
gggaggacgaugcgguuuuugucuuuuuucugcaccagacgacucgcccga

SEQ ID NO: 11953 - RNA, 51 nt, Artificial Sequence
  Description of Artificial Sequence: Synthetic oligonucleotide
gggaggacgaugcggauuuuaucgcuucuuugccgcagacgacucgcccga

SEQ ID NO: 11954 - RNA, 51 nt, Artificial Sequence
  Description of Artificial Sequence: Synthetic oligonucleotide
gggaggacgaugcggacuucuuuucuucuuaaccgcagacgacucgcccga

SEQ ID NO: 11955 - RNA, 50 nt, Artificial Sequence
  Description of Artificial Sequence: Synthetic oligonucleotide
gggaggacgaugcgguuucuuucauuuuuuuccgcagacgacucgcccga

SEQ ID NO: 11956 - RNA, 51 nt, Artificial Sequence
  Description of Artificial Sequence: Synthetic oligonucleotide
gggaggacgaugcggaccguuucuuuuucuugccgcagacgacucgcccga

SEQ ID NO: 11957 - RNA, 50 nt, Artificial Sequence
  Description of Artificial Sequence: Synthetic oligonucleotide
gggaggacgaugcgguccugucgcuguucguccccagacgacucgcccga

SEQ ID NO: 11958 - RNA, 51 nt, Artificial Sequence
  Description of Artificial Sequence: Synthetic oligonucleotide
gggaggacgaugcggaucucuucuuuuuccccccgcagacgacucgcccga

SEQ ID NO: 11959 - RNA, 51 nt, Artificial Sequence
  Description of Artificial Sequence: Synthetic oligonucleotide
gggaggacgaugcggccuuuuuacuauccucuccgcagacgacucgcccga

SEQ ID NO: 11960 - RNA, 50 nt, Artificial Sequence
  Description of Artificial Sequence: Synthetic oligonucleotide
gggaggacgaugcgguuuuauucuuuccgcuccgcagacgacucgcccga

SEQ ID NO: 11961 - RNA, 51 nt, Artificial Sequence
  Description of Artificial Sequence: Synthetic oligonucleotide
gggaggacgaugcgguuuucacuuuccuacuuccgcagacgacucgcccga

SEQ ID NO: 11962 - RNA, 51 nt, Artificial Sequence
  Description of Artificial Sequence: Synthetic oligonucleotide
gggaggacgaugcggcucacuugcucuuuucuccgcagacgacucgcccga

SEQ ID NO: 11963 - RNA, 52 nt, Artificial Sequence
  Description of Artificial Sequence: Synthetic oligonucleotide
gggaggacgaugcgguaucuucucuacucuacuccgcagacgacucgcccga

SEQ ID NO: 11964 - RNA, 51 nt, Artificial Sequence
  Description of Artificial Sequence: Synthetic oligonucleotide
gggaggacgaugcggacuuuccauuacuuuucccgcagacgacucgcccga

SEQ ID NO: 11965 - RNA, 51 nt, Artificial Sequence
  Description of Artificial Sequence: Synthetic oligonucleotide
gggaggacgaugcggccuuuacuuguuuuucaccgcagacgacucgcccga

SEQ ID NO: 11966 - RNA, 51 nt, Artificial Sequence
  Description of Artificial Sequence: Synthetic oligonucleotide
gggaggacgaugcggaucuuacuaauuccucuccgcagacgacucgcccga

SEQ ID NO: 11967 - RNA, 52 nt, Artificial Sequence
  Description of Artificial Sequence: Synthetic oligonucleotide
gggaggacgaugcggauuuucauuuuuuuuccgccgcagacgacucgcccga

SEQ ID NO: 11968 - RNA, 51 nt, Artificial Sequence
  Description of Artificial Sequence: Synthetic oligonucleotide
gggaggacgaugcggguuuuccuucauucuuuccgcagacgacucgcccga

SEQ ID NO: 11969 - RNA, 51 nt, Artificial Sequence
  Description of Artificial Sequence: Synthetic oligonucleotide
gggaggacgaugcggacuuuucuucguuuuacccgcagacgacucgcccga

SEQ ID NO: 11970 - RNA, 51 nt, Artificial Sequence
  Description of Artificial Sequence: Synthetic oligonucleotide
gggaggacgaugcggauucucuuauuaucuugccgcagacgacucgcccga

SEQ ID NO: 11971 - RNA, 52 nt, Artificial Sequence
  Description of Artificial Sequence: Synthetic oligonucleotide
gggaggacgaugcggucuuguuuuuuuuuuuggccccagacgacucgcccga

SEQ ID NO: 11972 - RNA, 51 nt, Artificial Sequence
  Description of Artificial Sequence: Synthetic oligonucleotide
gggaggacgaugcggaaucuucucauuucuuaccgcagacgacucgcccga

SEQ ID NO: 11973 - RNA, 51 nt, Artificial Sequence
  Description of Artificial Sequence: Synthetic oligonucleotide
gggaggacgaugcggauuucuucuuuuugccccugcagacgacucgcccga

SEQ ID NO: 11974 - RNA, 51 nt, Artificial Sequence
  Description of Artificial Sequence: Synthetic oligonucleotide
gggaggacgaugcgguuuuaugucuuuuugcuccgcagacgacucgcccga

SEQ ID NO: 11975 - RNA, 51 nt, Artificial Sequence
  Description of Artificial Sequence: Synthetic oligonucleotide
gggaggacgaugcggguuuucuuuucauuuuuccccagacgacucgcccga

SEQ ID NO: 11976 - RNA, 52 nt, Artificial Sequence
  Description of Artificial Sequence: Synthetic oligonucleotide
gggaggacgaugcggucuuuuuuugucuuucuuccgcagacgacucgcccga

SEQ ID NO: 11977 - RNA, 51 nt, Artificial Sequence
  Description of Artificial Sequence: Synthetic oligonucleotide
gggaggacgaugcggacuuuuuucucucuuuucugcagacgacucgcccga

SEQ ID NO: 11978 - RNA, 51 nt, Artificial Sequence
  Description of Artificial Sequence: Synthetic oligonucleotide
gggaggacgaugcgguuuuuuaacuucuuuuuccgcagacgacucgcccga

SEQ ID NO: 11979 - RNA, 50 nt, Artificial Sequence
  Description of Artificial Sequence: Synthetic oligonucleotide
gggaggacgaugcggacuuuucuuguuuauucugcagacgacucgcccga

SEQ ID NO: 11980 - RNA, 51 nt, Artificial Sequence
  Description of Artificial Sequence: Synthetic oligonucleotide
gggaggacgaugcgguuauuuuuuauccuuuuccgcagacgacucgcccga

SEQ ID NO: 11981 - RNA, 53 nt, Artificial Sequence
  Description of Artificial Sequence: Synthetic oligonucleotide
gggaggacgaugcgguucuuuauuuuuuuucccuccgcagacgacucgcccga

SEQ ID NO: 11982 - RNA, 50 nt, Artificial Sequence
  Description of Artificial Sequence: Synthetic oligonucleotide
gggaggacgaugcgguccuuucguucugccuccccagacgacucgcccga

SEQ ID NO: 11983 - RNA, 51 nt, Artificial Sequence
  Description of Artificial Sequence: Synthetic oligonucleotide
gggaggacgaugcggaucuuucucuuuacucuccgcagacgacucgcccga

SEQ ID NO: 11984 - RNA, 51 nt, Artificial Sequence
  Description of Artificial Sequence: Synthetic oligonucleotide
gggaggacgaugcgguuuauuuuucauucgccccgcagacgacucgcccga

SEQ ID NO: 11985 - RNA, 53 nt, Artificial Sequence
  Description of Artificial Sequence: Synthetic oligonucleotide
gggaggacgaugcggaccgcucuuuucuuuuucuccgcagacgacucgcccga

SEQ ID NO: 11986 - RNA, 51 nt, Artificial Sequence
  Description of Artificial Sequence: Synthetic oligonucleotide
gggaggacgaugcggucuuuucaucuacucauccgcagacgacucgcccga

SEQ ID NO: 11987 - RNA, 51 nt, Artificial Sequence
  Description of Artificial Sequence: Synthetic oligonucleotide
gggaggacgaugcgguuucacucucuuucacuccgcagacgacucgcccga

SEQ ID NO: 11988 - RNA, 51 nt, Artificial Sequence
  Description of Artificial Sequence: Synthetic oligonucleotide
gggaggacgaugcggucuuuuguaauugcucuccgcagacgacucgcccga

SEQ ID NO: 11989 - RNA, 51 nt, Artificial Sequence
  Description of Artificial Sequence: Synthetic oligonucleotide
gggaggacgaugcgguuuguuauucauuuuugccccagacgacucgcccga

SEQ ID NO: 11990 - RNA, 51 nt, Artificial Sequence
  Description of Artificial Sequence: Synthetic oligonucleotide
gggaggacgaugcggguucucuuuuuauucugccccagacgacucgcccga

SEQ ID NO: 11991 - RNA, 51 nt, Artificial Sequence
  Description of Artificial Sequence: Synthetic oligonucleotide
gggaggacgaugcgguccguuucuuucuuuauccgcagacgacucgcccga

SEQ ID NO: 11992 - RNA, 51 nt, Artificial Sequence
  Description of Artificial Sequence: Synthetic oligonucleotide
gggaggacgaugcgguuuuccaaugcucuuuuccgcagacgacucgcccga

SEQ ID NO: 11993 - RNA, 51 nt, Artificial Sequence
  Description of Artificial Sequence: Synthetic oligonucleotide
gggaggacgaugcgguuugggaguaugguguuccgcagacgacucgcccga

SEQ ID NO: 11994 - RNA, 51 nt, Artificial Sequence
  Description of Artificial Sequence: Synthetic oligonucleotide
gggaggacgaugcgguauucaucuuauucucuccgcagacgacucgcccga

SEQ ID NO: 11995 - RNA, 51 nt, Artificial Sequence
  Description of Artificial Sequence: Synthetic oligonucleotide
gggaggacgaugcggcuuuuaacauucucuuuccgcagacgacucgcccga

SEQ ID NO: 11996 - RNA, 51 nt, Artificial Sequence
  Description of Artificial Sequence: Synthetic oligonucleotide
gggaggacgaugcgggaucuacuuucuuuucaccccagacgacucgcccga

SEQ ID NO: 11997 - RNA, 51 nt, Artificial Sequence
  Description of Artificial Sequence: Synthetic oligonucleotide
gggaggacgaugcgggucuuuugauucuuuugccgcagacgacucgcccga

SEQ ID NO: 11998 - RNA, 51 nt, Artificial Sequence
  Description of Artificial Sequence: Synthetic oligonucleotide
gggaggacgaugcgguuuuuucuuugcccuuuccgcagacgacucgcccga

SEQ ID NO: 11999 - RNA, 51 nt, Artificial Sequence
  Description of Artificial Sequence: Synthetic oligonucleotide
gggaggacgaugcgguguuuuuuaugcuuuugccgcagacgacucgcccga

SEQ ID NO: 12000 - RNA, 51 nt, Artificial Sequence
  Description of Artificial Sequence: Synthetic oligonucleotide
gggaggacgaugcggcuuuuauuuuuucuuugccccagacgacucgcccga

SEQ ID NO: 12001 - RNA, 51 nt, Artificial Sequence
  Description of Artificial Sequence: Synthetic oligonucleotide
gggaggacgaugcggcucucuuuacauuuucuccgcagacgacucgcccga

SEQ ID NO: 12002 - RNA, 51 nt, Artificial Sequence
  Description of Artificial Sequence: Synthetic oligonucleotide
gggaggacgaugcggauuucuuagcuuccuuaccgcagacgacucgcccga

SEQ ID NO: 12003 - RNA, 51 nt, Artificial Sequence
  Description of Artificial Sequence: Synthetic oligonucleotide
gggaggacgaugcggcuuuucacuuuucucuucugcagacgacucgcccga

SEQ ID NO: 12004 - RNA, 51 nt, Artificial Sequence
  Description of Artificial Sequence: Synthetic oligonucleotide
gggaggacgaugcgguaucuuuaauucuuuuuccgcagacgacucgcccga

SEQ ID NO: 12005 - RNA, 51 nt, Artificial Sequence
  Description of Artificial Sequence: Synthetic oligonucleotide
gggaggacgaugcggcuuuuccuuauucuuuaccgcagacgacucgcccga

SEQ ID NO: 12006 - RNA, 52 nt, Artificial Sequence
  Description of Artificial Sequence: Synthetic oligonucleotide
gggaggacgaugcggauuuuuuuaguucuguuuccgcagacgacucgcccga

SEQ ID NO: 12007 - RNA, 51 nt, Artificial Sequence
  Description of Artificial Sequence: Synthetic oligonucleotide
gggaggacgaugcggucuuuucuaauuuuaccccgcagacgacucgcccga

SEQ ID NO: 12008 - RNA, 51 nt, Artificial Sequence
  Description of Artificial Sequence: Synthetic oligonucleotide
gggaggacgaugcgguuuucacuuacacuuuucgccagacgacucgcccga

SEQ ID NO: 12009 - RNA, 51 nt, Artificial Sequence
  Description of Artificial Sequence: Synthetic oligonucleotide
gggaggacgaugcgguuuuacacuuacuuuuucgccagacgacucgcccga

SEQ ID NO: 12010 - RNA, 51 nt, Artificial Sequence
  Description of Artificial Sequence: Synthetic oligonucleotide
gggaggacgaugcgguuuuuaucucguuuuuucugcagacgacucgcccga

SEQ ID NO: 12011 - RNA, 51 nt, Artificial Sequence
  Description of Artificial Sequence: Synthetic oligonucleotide
gggaggacgaugcggauuauuucuuucuuuuacugcagacgacucgcccga

SEQ ID NO: 12012 - RNA, 51 nt, Artificial Sequence
  Description of Artificial Sequence: Synthetic oligonucleotide
gggaggacgaugcgguuuuucuauguucuuuucgccagacgacucgcccga

SEQ ID NO: 12013 - RNA, 52 nt, Artificial Sequence
  Description of Artificial Sequence: Synthetic oligonucleotide
gggaggacgaugcgguuuuuuguuucucuguugcugcagacgacucgcccga

SEQ ID NO: 12014 - RNA, 51 nt, Artificial Sequence
  Description of Artificial Sequence: Synthetic oligonucleotide
gggaggacgaugcgguuuucgaguaccuuuuuccgcagacgacucgcccga

SEQ ID NO: 12015 - RNA, 51 nt, Artificial Sequence
  Description of Artificial Sequence: Synthetic oligonucleotide
gggaggacgaugcgguuuucguuguuuuuguuucgcagacgacucgcccga

SEQ ID NO: 12016 - RNA, 52 nt, Artificial Sequence
  Description of Artificial Sequence: Synthetic oligonucleotide
gggaggacgaugcgguuucuacuuuuuuauuguccgcagacgacucgcccga

SEQ ID NO: 12017 - RNA, 51 nt, Artificial Sequence
  Description of Artificial Sequence: Synthetic oligonucleotide
gggaggacgaugcgguuaguguuuaguuuuuugugcagacgacucgcccga

SEQ ID NO: 12018 - RNA, 51 nt, Artificial Sequence
  Description of Artificial Sequence: Synthetic oligonucleotide
gggaggacgaugcgguauuucacuuacuuuuucugcagacgacucgcccga

SEQ ID NO: 12019 - RNA, 51 nt, Artificial Sequence
  Description of Artificial Sequence: Synthetic oligonucleotide
gggaggacgaugcgguuuucacuucuuauuccccgcagacgacucgcccga

SEQ ID NO: 12020 - RNA, 51 nt, Artificial Sequence
  Description of Artificial Sequence: Synthetic oligonucleotide
gggaggacgaugcggcguuuccucuggcucguccccagacgacucgcccga

SEQ ID NO: 12021 - RNA, 49 nt, Artificial Sequence
  Description of Artificial Sequence: Synthetic oligonucleotide
gggaggacgaugcgguugucgucuguucguccccagacgacucgcccga

SEQ ID NO: 12022 - RNA, 51 nt, Artificial Sequence
  Description of Artificial Sequence: Synthetic oligonucleotide
gggaggacgaugcggaucuuacucucuuuucgccgcagacgacucgcccga

SEQ ID NO: 12023 - RNA, 51 nt, Artificial Sequence
  Description of Artificial Sequence: Synthetic oligonucleotide
gggaggacgaugcggcuuugcucuuuuuguuaccgcagacgacucgcccga

SEQ ID NO: 12024 - RNA, 51 nt, Artificial Sequence
  Description of Artificial Sequence: Synthetic oligonucleotide
gggaggacgaugcgguuugggaguaggguguucugcagacgacucgcccga

SEQ ID NO: 12025 - RNA, 51 nt, Artificial Sequence
  Description of Artificial Sequence: Synthetic oligonucleotide
gggaggacgaugcgggauuucuuauucccuuuccccagacgacucgcccga

SEQ ID NO: 12026 - RNA, 51 nt, Artificial Sequence
  Description of Artificial Sequence: Synthetic oligonucleotide
gggaggacgaugcgguaucuuuucuuuuuccccggcagacgacucgcccga

SEQ ID NO: 12027 - RNA, 51 nt, Artificial Sequence
  Description of Artificial Sequence: Synthetic oligonucleotide
gggaggacgaugcgguuucaaacuuuuacuuuccgcagacgacucgcccga

SEQ ID NO: 12028 - RNA, 51 nt, Artificial Sequence
  Description of Artificial Sequence: Synthetic oligonucleotide
gggaggacgaugcggucauuuauauucuuccuccgcagacgacucgcccga

SEQ ID NO: 12029 - RNA, 51 nt, Artificial Sequence
  Description of Artificial Sequence: Synthetic oligonucleotide
gggaggacgaugcggcauuucuucuuuucguucgccagacgacucgcccga

SEQ ID NO: 12030 - RNA, 51 nt, Artificial Sequence
  Description of Artificial Sequence: Synthetic oligonucleotide
gggaggacgaugcggaacuuuuuucuuuuaugccgcagacgacucgcccga

SEQ ID NO: 12031 - RNA, 52 nt, Artificial Sequence
  Description of Artificial Sequence: Synthetic oligonucleotide
gggaggacgaugcggguuugcucuuuuuuucugccgcagacgacucgcccga

SEQ ID NO: 12032 - RNA, 51 nt, Artificial Sequence
  Description of Artificial Sequence: Synthetic oligonucleotide
gggaggacgaugcggcuuuuccacuauucguuccgcagacgacucgcccga

SEQ ID NO: 12033 - RNA, 51 nt, Artificial Sequence
  Description of Artificial Sequence: Synthetic oligonucleotide
gggaggacgaugcgguuuuuucauauuacgcuccgcagacgacucgcccga

SEQ ID NO: 12034 - RNA, 52 nt, Artificial Sequence
  Description of Artificial Sequence: Synthetic oligonucleotide
gggaggacgaugcgguuauuuuuucuucgcuguccgcagacgacucgcccga

SEQ ID NO: 12035 - RNA, 51 nt, Artificial Sequence
  Description of Artificial Sequence: Synthetic oligonucleotide
gggaggacgaugcggauucuucaucuuuugccccgcagacgacucgcccga

SEQ ID NO: 12036 - RNA, 51 nt, Artificial Sequence
  Description of Artificial Sequence: Synthetic oligonucleotide
gggaggacgaugcggcuucauuuauuucuccaccgcagacgacucgcccga

SEQ ID NO: 12037 - RNA, 51 nt, Artificial Sequence
  Description of Artificial Sequence: Synthetic oligonucleotide
gggaggacgaugcgggcuuucuuucuucuuuccugcagacgacucgcccga

SEQ ID NO: 12038 - RNA, 51 nt, Artificial Sequence
  Description of Artificial Sequence: Synthetic oligonucleotide
gggaggacgaugcggauucucuuuuucucuaaccgcagacgacucgcccga

SEQ ID NO: 12039 - RNA, 51 nt, Artificial Sequence
  Description of Artificial Sequence: Synthetic oligonucleotide
gggaggacgaugcggcauuucuuuauuucuuuccgcagacgacucgcccga

SEQ ID NO: 12040 - RNA, 51 nt, Artificial Sequence
  Description of Artificial Sequence: Synthetic oligonucleotide
gggaggacgaugcggcuauuucuaaucucucuccgcagacgacucgcccga

SEQ ID NO: 12041 - RNA, 51 nt, Artificial Sequence
  Description of Artificial Sequence: Synthetic oligonucleotide
gggaggacgaugcggccuacuuuuuucuuuuuccgcagacgacucgcccga

SEQ ID NO: 12042 - RNA, 51 nt, Artificial Sequence
  Description of Artificial Sequence: Synthetic oligonucleotide
gggaggacgaugcggauucuuuuguuuuuuucccgcagacgacucgcccga

SEQ ID NO: 12043 - RNA, 50 nt, Artificial Sequence
  Description of Artificial Sequence: Synthetic oligonucleotide
gggaggacgaugcggcuuuuuuauuucccuuccgcagacgacucgcccga

SEQ ID NO: 12044 - RNA, 51 nt, Artificial Sequence
  Description of Artificial Sequence: Synthetic oligonucleotide
gggaggacgaugcgguuuuuacagauuuuugcccgcagacgacucgcccga

SEQ ID NO: 12045 - RNA, 51 nt, Artificial Sequence
  Description of Artificial Sequence: Synthetic oligonucleotide
gggaggacgaugcgguuuuauugauuuuguuuccccagacgacucgcccga

SEQ ID NO: 12046 - RNA, 51 nt, Artificial Sequence
  Description of Artificial Sequence: Synthetic oligonucleotide
gggaggacgaugcgguauuucucuauuuuccucugcagacgacucgcccga

SEQ ID NO: 12047 - RNA, 51 nt, Artificial Sequence
  Description of Artificial Sequence: Synthetic oligonucleotide
gggaggacgaugcgguguuuucuuucuucauuccgcagacgacucgcccga

SEQ ID NO: 12048 - RNA, 51 nt, Artificial Sequence
  Description of Artificial Sequence: Synthetic oligonucleotide
gggaggacgaugcgguuuauuucuuugcucuugcccagacgacucgcccga

SEQ ID NO: 12049 - RNA, 51 nt, Artificial Sequence
  Description of Artificial Sequence: Synthetic oligonucleotide
gggaggacgaugcggauuuuauuccuuuuuucccgcagacgacucgcccga

SEQ ID NO: 12050 - RNA, 51 nt, Artificial Sequence
  Description of Artificial Sequence: Synthetic oligonucleotide
gggaggacgaugcgguuuauuuuuuuuucgcuccgcagacgacucgcccga

SEQ ID NO: 12051 - RNA, 51 nt, Artificial Sequence
  Description of Artificial Sequence: Synthetic oligonucleotide
gggaggacgaugcggucugaauaggaggaggaggccagacgacucgcccga

SEQ ID NO: 12052 - RNA, 51 nt, Artificial Sequence
  Description of Artificial Sequence: Synthetic oligonucleotide
gggaggacgaugcgguuucgcuuucauauuuuccgcagacgacucgcccga

SEQ ID NO: 12053 - RNA, 51 nt, Artificial Sequence
  Description of Artificial Sequence: Synthetic oligonucleotide
gggaggacgaugcggacuuuuuguuauuuuuugcccagacgacucgcccga

SEQ ID NO: 12054 - RNA, 51 nt, Artificial Sequence
  Description of Artificial Sequence: Synthetic oligonucleotide
gggaggacgaugcgguccuggcuugucguugcccccagacgacucgcccga

SEQ ID NO: 12055 - RNA, 51 nt, Artificial Sequence
  Description of Artificial Sequence: Synthetic oligonucleotide
gggaggacgaugcggucuauucuuuugcucuuccgcagacgacucgcccga

SEQ ID NO: 12056 - RNA, 51 nt, Artificial Sequence
  Description of Artificial Sequence: Synthetic oligonucleotide
gggaggacgaugcggauucuuuguauuuuugcccgcagacgacucgcccga

SEQ ID NO: 12057 - RNA, 51 nt, Artificial Sequence
  Description of Artificial Sequence: Synthetic oligonucleotide
gggaggacgaugcggauuuuauucccuuguugccgcagacgacucgcccga

SEQ ID NO: 12058 - RNA, 51 nt, Artificial Sequence
  Description of Artificial Sequence: Synthetic oligonucleotide
gggaggacgaugcggaucgcucuauuuuuucuccgcagacgacucgcccga

SEQ ID NO: 12059 - RNA, 51 nt, Artificial Sequence
  Description of Artificial Sequence: Synthetic oligonucleotide
gggaggacgaugcggcuccuuguucuuuuccuccgcagacgacucgcccga

SEQ ID NO: 12060 - RNA, 51 nt, Artificial Sequence
  Description of Artificial Sequence: Synthetic oligonucleotide
gggaggacgaugcggggcuuuuaccuuuuuucccccagacgacucgcccga

SEQ ID NO: 12061 - RNA, 51 nt, Artificial Sequence
  Description of Artificial Sequence: Synthetic oligonucleotide
gggaggacgaugcgguauuucucuuaacuccuccgcagacgacucgcccga

SEQ ID NO: 12062 - RNA, 53 nt, Artificial Sequence
  Description of Artificial Sequence: Synthetic oligonucleotide
gggaggacgaugcggucuuguuuuuuuuuuuuggccccagacgacucgcccga

SEQ ID NO: 12063 - RNA, 51 nt, Artificial Sequence
  Description of Artificial Sequence: Synthetic oligonucleotide
gggaggacgaugcggcuuuucucuuucaccuaccgcagacgacucgcccga

SEQ ID NO: 12064 - RNA, 51 nt, Artificial Sequence
  Description of Artificial Sequence: Synthetic oligonucleotide
gggaggacgaugcgguuuucuaucuucuuuguccgcagacgacucgcccga

SEQ ID NO: 12065 - RNA, 51 nt, Artificial Sequence
  Description of Artificial Sequence: Synthetic oligonucleotide
gggaggacgaugcggcuuucucacccuuuuuuccgcagacgacucgcccga

SEQ ID NO: 12066 - RNA, 51 nt, Artificial Sequence
  Description of Artificial Sequence: Synthetic oligonucleotide
gggaggacgaugcgguuuuauuaaauccguuuccgcagacgacucgcccga

SEQ ID NO: 12067 - RNA, 51 nt, Artificial Sequence
  Description of Artificial Sequence: Synthetic oligonucleotide
gggaggacgaugcggaucuucuuuguuuuuugcugcagacgacucgcccga

SEQ ID NO: 12068 - RNA, 51 nt, Artificial Sequence
  Description of Artificial Sequence: Synthetic oligonucleotide
gggaggacgaugcggaaaaaggaggagguggugugcagacgacucgcccga

SEQ ID NO: 12069 - RNA, 50 nt, Artificial Sequence
  Description of Artificial Sequence: Synthetic oligonucleotide
gggaggacgaugcggucuuuuuuuguuucccccgcagacgacucgcccga

SEQ ID NO: 12070 - RNA, 51 nt, Artificial Sequence
  Description of Artificial Sequence: Synthetic oligonucleotide
gggaggacgaugcggccuuuuuccuuaucuuuccgcagacgacucgcccga

SEQ ID NO: 12071 - RNA, 51 nt, Artificial Sequence
  Description of Artificial Sequence: Synthetic oligonucleotide
gggaggacgaugcggauucucuuuuucuauuaccgcagacgacucgcccga

SEQ ID NO: 12072 - RNA, 52 nt, Artificial Sequence
  Description of Artificial Sequence: Synthetic oligonucleotide
gggaggacgaugcggguucauguuuuccuuuucguccagacgacucgcccga

SEQ ID NO: 12073 - RNA, 51 nt, Artificial Sequence
  Description of Artificial Sequence: Synthetic oligonucleotide
gggaggacgaugcggauuuugucuuuuuccuucugcagacgacucgcccga

SEQ ID NO: 12074 - RNA, 51 nt, Artificial Sequence
  Description of Artificial Sequence: Synthetic oligonucleotide
gggaggacgaugcgguuucuguuuuuuuauucccgcagacgacucgcccga

SEQ ID NO: 12075 - RNA, 51 nt, Artificial Sequence
  Description of Artificial Sequence: Synthetic oligonucleotide
gggaggacgaugcggucuuucuuuucuuauuuccgcagacgacucgcccga

SEQ ID NO: 12076 - RNA, 51 nt, Artificial Sequence
  Description of Artificial Sequence: Synthetic oligonucleotide
gggaggacgaugcggauuggugaagggugguugcgcagacgacucgcccga

SEQ ID NO: 12077 - RNA, 51 nt, Artificial Sequence
  Description of Artificial Sequence: Synthetic oligonucleotide
gggaggacgaugcggguuuucucucuuauuuuccgcagacgacucgcccga

SEQ ID NO: 12078 - RNA, 51 nt, Artificial Sequence
  Description of Artificial Sequence: Synthetic oligonucleotide
gggaggacgaugcgguacuuauuugccuuuuuccgcagacgacucgcccga

SEQ ID NO: 12079 - RNA, 51 nt, Artificial Sequence
  Description of Artificial Sequence: Synthetic oligonucleotide
gggaggacgaugcggccuuuuucauuauucuuccgcagacgacucgcccga

SEQ ID NO: 12080 - RNA, 51 nt, Artificial Sequence
  Description of Artificial Sequence: Synthetic oligonucleotide
gggaggacgaugcggcauuuauuauuuuuuccccgcagacgacucgcccga

SEQ ID NO: 12081 - RNA, 51 nt, Artificial Sequence
  Description of Artificial Sequence: Synthetic oligonucleotide
gggaggacgaugcggaauuuuuccuucuuuacccgcagacgacucgcccga

SEQ ID NO: 12082 - RNA, 51 nt, Artificial Sequence
  Description of Artificial Sequence: Synthetic oligonucleotide
gggaggacgaugcgguuuucuuuuucuauuuugcccagacgacucgcccga

SEQ ID NO: 12083 - RNA, 51 nt, Artificial Sequence
  Description of Artificial Sequence: Synthetic oligonucleotide
gggaggacgaugcgguacuuuucuuucauuuugcccagacgacucgcccga

SEQ ID NO: 12084 - RNA, 51 nt, Artificial Sequence
  Description of Artificial Sequence: Synthetic oligonucleotide
gggaggacgaugcgguuucacuuuuuuacuuucgccagacgacucgcccga

SEQ ID NO: 12085 - RNA, 52 nt, Artificial Sequence
  Description of Artificial Sequence: Synthetic oligonucleotide
gggaggacgaugcgguauuucacuguuuuuuugcugcagacgacucgcccga

SEQ ID NO: 12086 - RNA, 51 nt, Artificial Sequence
  Description of Artificial Sequence: Synthetic oligonucleotide
gggaggacgaugcgguguuuuuuuuacuuuucccgcagacgacucgcccga

SEQ ID NO: 12087 - RNA, 51 nt, Artificial Sequence
  Description of Artificial Sequence: Synthetic oligonucleotide
gggaggacgaugcggucugguuucuuuuguuuccgcagacgacucgcccga

SEQ ID NO: 12088 - RNA, 51 nt, Artificial Sequence
  Description of Artificial Sequence: Synthetic oligonucleotide
gggaggacgaugcgguaucucacacuuucuuuccgcagacgacucgcccga

SEQ ID NO: 12089 - RNA, 51 nt, Artificial Sequence
  Description of Artificial Sequence: Synthetic oligonucleotide
gggaggacgaugcggauucucaauuucucucgccgcagacgacucgcccga

SEQ ID NO: 12090 - RNA, 52 nt, Artificial Sequence
  Description of Artificial Sequence: Synthetic oligonucleotide
gggaggacgaugcgguuauuuuuccuuuuucugccgcagacgacucgcccga

SEQ ID NO: 12091 - RNA, 51 nt, Artificial Sequence
  Description of Artificial Sequence: Synthetic oligonucleotide
gggaggacgaugcgguuucucuuaauuuucccccgcagacgacucgcccga

SEQ ID NO: 12092 - RNA, 51 nt, Artificial Sequence
  Description of Artificial Sequence: Synthetic oligonucleotide
gggaggacgaugcggucaucuuuacucuucauccgcagacgacucgcccga

SEQ ID NO: 12093 - RNA, 50 nt, Artificial Sequence
  Description of Artificial Sequence: Synthetic oligonucleotide
gggaggacgaugcgguuuugcuuuuuuuuucccccagacgacucgcccga

SEQ ID NO: 12094 - RNA, 51 nt, Artificial Sequence
  Description of Artificial Sequence: Synthetic oligonucleotide
gggaggacgaugcgguuuuucauuccccuuuuccgcagacgacucgcccga

SEQ ID NO: 12095 - RNA, 52 nt, Artificial Sequence
  Description of Artificial Sequence: Synthetic oligonucleotide
gggaggacgaugcggcuuuuccuuuuuuucacuccgcagacgacucgcccga

SEQ ID NO: 12096 - RNA, 51 nt, Artificial Sequence
  Description of Artificial Sequence: Synthetic oligonucleotide
gggaggacgaugcggucuuguuuuuuuuuuggccccagacgacucgcccga

SEQ ID NO: 12097 - RNA, 50 nt, Artificial Sequence
  Description of Artificial Sequence: Synthetic oligonucleotide
gggaggacgaugcggucacuuuuuuucaucuccgcagacgacucgcccga

SEQ ID NO: 12098 - RNA, 53 nt, Artificial Sequence
  Description of Artificial Sequence: Synthetic oligonucleotide
gggaggacgaugcgguuuuuuuauuuuccugguuccgcagacgacucgcccga

SEQ ID NO: 12099 - RNA, 50 nt, Artificial Sequence
  Description of Artificial Sequence: Synthetic oligonucleotide
gggaggacgaugcgguuuucuugcccuuuuuccgcagacgacucgcccga

SEQ ID NO: 12100 - RNA, 51 nt, Artificial Sequence
  Description of Artificial Sequence: Synthetic oligonucleotide
gggaggacgaugcgguuuaugagaguaggguggugcagacgacucgcccga

SEQ ID NO: 12101 - RNA, 51 nt, Artificial Sequence
  Description of Artificial Sequence: Synthetic oligonucleotide
gggaggacgaugcggauuguuuuauuuucucaccccagacgacucgcccga

SEQ ID NO: 12102 - RNA, 51 nt, Artificial Sequence
  Description of Artificial Sequence: Synthetic oligonucleotide
gggaggacgaugcggcuuuuacauuauuuucuccgcagacgacucgcccga

SEQ ID NO: 12103 - RNA, 52 nt, Artificial Sequence
  Description of Artificial Sequence: Synthetic oligonucleotide
gggaggacgaugcgguuguuucuaccuuuuuuuccgcagacgacucgcccga

SEQ ID NO: 12104 - RNA, 49 nt, Artificial Sequence
  Description of Artificial Sequence: Synthetic oligonucleotide
gggaggacgaugcgguuuaucuuuuuuugugugcagacgacucgcccga

SEQ ID NO: 12105 - RNA, 51 nt, Artificial Sequence
  Description of Artificial Sequence: Synthetic oligonucleotide
gggaggacgaugcggaucuuucgcuuuuuuucccgcagacgacucgcccga

SEQ ID NO: 12106 - RNA, 51 nt, Artificial Sequence
  Description of Artificial Sequence: Synthetic oligonucleotide
gggaggacgaugcggcuuuccuaauuuucucuccgcagacgacucgcccga

SEQ ID NO: 12107 - RNA, 51 nt, Artificial Sequence
  Description of Artificial Sequence: Synthetic oligonucleotide
gggaggacgaugcggcuguucuuuuccuuuuaccccagacgacucgcccga

SEQ ID NO: 12108 - RNA, 50 nt, Artificial Sequence
  Description of Artificial Sequence: Synthetic oligonucleotide
gggaggacgaugcgguuuauucuguuuuuuuccgcagacgacucgcccga

SEQ ID NO: 12109 - RNA, 51 nt, Artificial Sequence
  Description of Artificial Sequence: Synthetic oligonucleotide
gggaggacgaugcgguuuuacuguuuuucuuugcgcagacgacucgcccga

SEQ ID NO: 12110 - RNA, 51 nt, Artificial Sequence
  Description of Artificial Sequence: Synthetic oligonucleotide
gggaggacgaugcggcuuuuguuuguuucuuugcgcagacgacucgcccga

SEQ ID NO: 12111 - RNA, 51 nt, Artificial Sequence
  Description of Artificial Sequence: Synthetic oligonucleotide
gggaggacgaugcgguucuauuuaauuuuucuccgcagacgacucgcccga

SEQ ID NO: 12112 - RNA, 51 nt, Artificial Sequence
  Description of Artificial Sequence: Synthetic oligonucleotide
gggaggacgaugcggguuuucaagacuuuuuuccccagacgacucgcccga

SEQ ID NO: 12113 - RNA, 51 nt, Artificial Sequence
  Description of Artificial Sequence: Synthetic oligonucleotide
gggaggacgaugcgguuuguaauguuuuuuuuccgcagacgacucgcccga

SEQ ID NO: 12114 - RNA, 52 nt, Artificial Sequence
  Description of Artificial Sequence: Synthetic oligonucleotide
gggaggacgaugcgguucguacuuuuuuuuuuuccgcagacgacucgcccga

SEQ ID NO: 12115 - RNA, 52 nt, Artificial Sequence
  Description of Artificial Sequence: Synthetic oligonucleotide
gggaggacgaugcggcuuuuuuuuccuuuuuuuccgcagacgacucgcccga

SEQ ID NO: 12116 - RNA, 51 nt, Artificial Sequence
  Description of Artificial Sequence: Synthetic oligonucleotide
gggaggacgaugcggaucuucauuaucuuuuugcccagacgacucgcccga

SEQ ID NO: 12117 - RNA, 51 nt, Artificial Sequence
  Description of Artificial Sequence: Synthetic oligonucleotide
gggaggacgaugcgguuuuugcacuuauuuuuccgcagacgacucgcccga

SEQ ID NO: 12118 - RNA, 53 nt, Artificial Sequence
  Description of Artificial Sequence: Synthetic oligonucleotide
gggaggacgaugcgguauuuugucacuuuuuuuucugcagacgacucgcccga

SEQ ID NO: 12119 - RNA, 51 nt, Artificial Sequence
  Description of Artificial Sequence: Synthetic oligonucleotide
gggaggacgaugcgguguuuuuucuuuucugucugcagacgacucgcccga

SEQ ID NO: 12120 - RNA, 51 nt, Artificial Sequence
  Description of Artificial Sequence: Synthetic oligonucleotide
gggaggacgaugcgguuucgauuuuauuuuuuccccagacgacucgcccga

SEQ ID NO: 12121 - RNA, 51 nt, Artificial Sequence
  Description of Artificial Sequence: Synthetic oligonucleotide
gggaggacgaugcggauuaccuuuuucccuuuccgcagacgacucgcccga

SEQ ID NO: 12122 - RNA, 51 nt, Artificial Sequence
  Description of Artificial Sequence: Synthetic oligonucleotide
gggaggacgaugcggaguuuuuuccauuuuugccccagacgacucgcccga

SEQ ID NO: 12123 - RNA, 51 nt, Artificial Sequence
  Description of Artificial Sequence: Synthetic oligonucleotide
gggaggacgaugcggacuacuuuucucuuuuuccgcagacgacucgcccga

SEQ ID NO: 12124 - RNA, 51 nt, Artificial Sequence
  Description of Artificial Sequence: Synthetic oligonucleotide
gggaggacgaugcggcauuuacuuuuuacccuccgcagacgacucgcccga

SEQ ID NO: 12125 - RNA, 51 nt, Artificial Sequence
  Description of Artificial Sequence: Synthetic oligonucleotide
gggaggacgaugcgguuuccuuuuccuuuucccgccagacgacucgcccga

SEQ ID NO: 12126 - RNA, 51 nt, Artificial Sequence
  Description of Artificial Sequence: Synthetic oligonucleotide
gggaggacgaugcgggauuuucuuccuuuuugccgcagacgacucgcccga

SEQ ID NO: 12127 - RNA, 51 nt, Artificial Sequence
  Description of Artificial Sequence: Synthetic oligonucleotide
gggaggacgaugcgguuuccuaaauuuuuccuccgcagacgacucgcccga

SEQ ID NO: 12128 - RNA, 51 nt, Artificial Sequence
  Description of Artificial Sequence: Synthetic oligonucleotide
gggaggacgaugcggucucaucuauuuuucuuccgcagacgacucgcccga

SEQ ID NO: 12129 - RNA, 51 nt, Artificial Sequence
  Description of Artificial Sequence: Synthetic oligonucleotide
gggaggacgaugcggacuucucuauucuuuucccgcagacgacucgcccga

SEQ ID NO: 12130 - RNA, 52 nt, Artificial Sequence
  Description of Artificial Sequence: Synthetic oligonucleotide
gggaggacgaugcgguuuuuuugauucuuguuuccgcagacgacucgcccga

SEQ ID NO: 12131 - RNA, 51 nt, Artificial Sequence
  Description of Artificial Sequence: Synthetic oligonucleotide
gggaggacgaugcgguucuuugucuauuuucccgccagacgacucgcccga

SEQ ID NO: 12132 - RNA, 51 nt, Artificial Sequence
  Description of Artificial Sequence: Synthetic oligonucleotide
gggaggacgaugcggucauuuuaauuugcucuccgcagacgacucgcccga

SEQ ID NO: 12133 - RNA, 51 nt, Artificial Sequence
  Description of Artificial Sequence: Synthetic oligonucleotide
gggaggacgaugcggcuuuuaaucucuuuuuaccgcagacgacucgcccga

SEQ ID NO: 12134 - RNA, 51 nt, Artificial Sequence
  Description of Artificial Sequence: Synthetic oligonucleotide
gggaggacgaugcgguuauuugugauuuuuuuccgcagacgacucgcccga

SEQ ID NO: 12135 - RNA, 51 nt, Artificial Sequence
  Description of Artificial Sequence: Synthetic oligonucleotide
gggaggacgaugcgguuucucagcuuuuuuuuccgcagacgacucgcccga

SEQ ID NO: 12136 - RNA, 51 nt, Artificial Sequence
  Description of Artificial Sequence: Synthetic oligonucleotide
gggaggacgaugcgggacuuuauucuuuucuugcccagacgacucgcccga

SEQ ID NO: 12137 - RNA, 51 nt, Artificial Sequence
  Description of Artificial Sequence: Synthetic oligonucleotide
gggaggacgaugcgguuuuacauuuuuuuucgcugcagacgacucgcccga

SEQ ID NO: 12138 - RNA, 52 nt, Artificial Sequence
  Description of Artificial Sequence: Synthetic oligonucleotide
gggaggacgaugcggauuuuuuuccuguuuuugccgcagacgacucgcccga

SEQ ID NO: 12139 - RNA, 52 nt, Artificial Sequence
  Description of Artificial Sequence: Synthetic oligonucleotide
gggaggacgaugcgguuucuuucauuuuuuuuuccgcagacgacucgcccga

SEQ ID NO: 12140 - RNA, 51 nt, Artificial Sequence
  Description of Artificial Sequence: Synthetic oligonucleotide
gggaggacgaugcggacuuuuugcuuauuuacccgcagacgacucgcccga

SEQ ID NO: 12141 - RNA, 51 nt, Artificial Sequence
  Description of Artificial Sequence: Synthetic oligonucleotide
gggaggacgaugcgguuuugcuuuuuuuuuucccccagacgacucgcccga

SEQ ID NO: 12142 - RNA, 51 nt, Artificial Sequence
  Description of Artificial Sequence: Synthetic oligonucleotide
gggaggacgaugcggacuuuuucucuuuucuaccgcagacgacucgcccga

SEQ ID NO: 12143 - RNA, 51 nt, Artificial Sequence
  Description of Artificial Sequence: Synthetic oligonucleotide
gggaggacgaugcgguucgcuuaauucuuuucccgcagacgacucgcccga

SEQ ID NO: 12144 - RNA, 51 nt, Artificial Sequence
  Description of Artificial Sequence: Synthetic oligonucleotide
gggaggacgaugcgguuuuauuuauuucugucccgcagacgacucgcccga

SEQ ID NO: 12145 - RNA, 51 nt, Artificial Sequence
  Description of Artificial Sequence: Synthetic oligonucleotide
gggaggacgaugcgguuuucuucaauauuuucccgcagacgacucgcccga

SEQ ID NO: 12146 - RNA, 51 nt, Artificial Sequence
  Description of Artificial Sequence: Synthetic oligonucleotide
gggaggacgaugcggucuuauuauuucuuucccgccagacgacucgcccga

SEQ ID NO: 12147 - RNA, 51 nt, Artificial Sequence
  Description of Artificial Sequence: Synthetic oligonucleotide
gggaggacgaugcgguguuuuucuauuuuuuuccccagacgacucgcccga

SEQ ID NO: 12148 - RNA, 51 nt, Artificial Sequence
  Description of Artificial Sequence: Synthetic oligonucleotide
gggaggacgaugcggauuuuauuucucuuuucccgcagacgacucgcccga

SEQ ID NO: 12149 - RNA, 51 nt, Artificial Sequence
  Description of Artificial Sequence: Synthetic oligonucleotide
gggaggacgaugcggauucuuuuuuguuuuuugcccagacgacucgcccga

SEQ ID NO: 12150 - RNA, 51 nt, Artificial Sequence
  Description of Artificial Sequence: Synthetic oligonucleotide
gggaggacgaugcgguccuugucgucucgcguccccagacgacucgcccga

SEQ ID NO: 12151 - RNA, 51 nt, Artificial Sequence
  Description of Artificial Sequence: Synthetic oligonucleotide
gggaggacgaugcgguuugggaguaagguguuccgcagacgacucgcccga

SEQ ID NO: 12152 - RNA, 51 nt, Artificial Sequence
  Description of Artificial Sequence: Synthetic oligonucleotide
gggaggacgaugcggguucuuauccuucuguuccgcagacgacucgcccga

SEQ ID NO: 12153 - RNA, 51 nt, Artificial Sequence
  Description of Artificial Sequence: Synthetic oligonucleotide
gggaggacgaugcgguuuuucgaucuuuguuuccgcagacgacucgcccga

SEQ ID NO: 12154 - RNA, 51 nt, Artificial Sequence
  Description of Artificial Sequence: Synthetic oligonucleotide
gggaggacgaugcggauuucuucacuugcucaccgcagacgacucgcccga

SEQ ID NO: 12155 - RNA, 51 nt, Artificial Sequence
  Description of Artificial Sequence: Synthetic oligonucleotide
gggaggacgaugcggaacucucucuuuuucugccgcagacgacucgcccga

SEQ ID NO: 12156 - RNA, 51 nt, Artificial Sequence
  Description of Artificial Sequence: Synthetic oligonucleotide
gggaggacgaugcggguuguucuuuuaccuccggccagacgacucgcccga

SEQ ID NO: 12157 - RNA, 50 nt, Artificial Sequence
  Description of Artificial Sequence: Synthetic oligonucleotide
gggaggacgaugcgguuccacuuuuuuuucuccgcagacgacucgcccga

SEQ ID NO: 12158 - RNA, 51 nt, Artificial Sequence
  Description of Artificial Sequence: Synthetic oligonucleotide
gggaggacgaugcggucuauucucuauuucuuccgcagacgacucgcccga

SEQ ID NO: 12159 - RNA, 51 nt, Artificial Sequence
  Description of Artificial Sequence: Synthetic oligonucleotide
gggaggacgaugcggcauuucacuucuuuucgcugcagacgacucgcccga

SEQ ID NO: 12160 - RNA, 51 nt, Artificial Sequence
  Description of Artificial Sequence: Synthetic oligonucleotide
gggaggacgaugcggacauuucauuuuuucccccgcagacgacucgcccga

SEQ ID NO: 12161 - RNA, 51 nt, Artificial Sequence
  Description of Artificial Sequence: Synthetic oligonucleotide
gggaggacgaugcggcuucuauuauuuuccauccgcagacgacucgcccga

SEQ ID NO: 12162 - RNA, 51 nt, Artificial Sequence
  Description of Artificial Sequence: Synthetic oligonucleotide
gggaggacgaugcgguauuucacuguuuuuugcugcagacgacucgcccga

SEQ ID NO: 12163 - RNA, 51 nt, Artificial Sequence
  Description of Artificial Sequence: Synthetic oligonucleotide
gggaggacgaugcggacuuucucucucucuuuccgcagacgacucgcccga

SEQ ID NO: 12164 - RNA, 51 nt, Artificial Sequence
  Description of Artificial Sequence: Synthetic oligonucleotide
gggaggacgaugcggucuuuacuuuuacaucuccgcagacgacucgcccga

SEQ ID NO: 12165 - RNA, 51 nt, Artificial Sequence
  Description of Artificial Sequence: Synthetic oligonucleotide
gggaggacgaugcggauuuuauucuuugguucccgcagacgacucgcccga

SEQ ID NO: 12166 - RNA, 51 nt, Artificial Sequence
  Description of Artificial Sequence: Synthetic oligonucleotide
gggaggacgaugcggacucauucauuucucuaccgcagacgacucgcccga

SEQ ID NO: 12167 - RNA, 51 nt, Artificial Sequence
  Description of Artificial Sequence: Synthetic oligonucleotide
gggaggacgaugcggcuuuuaaauuucuccuuccgcagacgacucgcccga

SEQ ID NO: 12168 - RNA, 51 nt, Artificial Sequence
  Description of Artificial Sequence: Synthetic oligonucleotide
gggaggacgaugcggccauuuuuucuuuuccugcccagacgacucgcccga

SEQ ID NO: 12169 - RNA, 51 nt, Artificial Sequence
  Description of Artificial Sequence: Synthetic oligonucleotide
gggaggacgaugcggauuucuucgacuuuccuccgcagacgacucgcccga

SEQ ID NO: 12170 - RNA, 51 nt, Artificial Sequence
  Description of Artificial Sequence: Synthetic oligonucleotide
gggaggacgaugcgguuucuacacuucuuuuuccgcagacgacucgcccga

SEQ ID NO: 12171 - RNA, 51 nt, Artificial Sequence
  Description of Artificial Sequence: Synthetic oligonucleotide
gggaggacgaugcggauuuuguuauguuuuugccacagacgacucgcccga

SEQ ID NO: 12172 - RNA, 53 nt, Artificial Sequence
  Description of Artificial Sequence: Synthetic oligonucleotide
gggaggacgaugcggucuuuuuuuuguuuuucugccgcagacgacucgcccga

SEQ ID NO: 12173 - RNA, 51 nt, Artificial Sequence
  Description of Artificial Sequence: Synthetic oligonucleotide
gggaggacgaugcggccuuucuuuccauuuuuccgcagacgacucgcccga

SEQ ID NO: 12174 - RNA, 51 nt, Artificial Sequence
  Description of Artificial Sequence: Synthetic oligonucleotide
gggaggacgaugcggaucuuuacauucacuuaccgcagacgacucgcccga

SEQ ID NO: 12175 - RNA, 51 nt, Artificial Sequence
  Description of Artificial Sequence: Synthetic oligonucleotide
gggaggacgaugcgguuucauacucauuuuuuccgcagacgacucgcccga

SEQ ID NO: 12176 - RNA, 51 nt, Artificial Sequence
  Description of Artificial Sequence: Synthetic oligonucleotide
gggaggacgaugcggccuuuucuacuucuuauccgcagacgacucgcccga

SEQ ID NO: 12177 - RNA, 51 nt, Artificial Sequence
  Description of Artificial Sequence: Synthetic oligonucleotide
gggaggacgaugcggacuuuuuauuuuuaucaccgcagacgacucgcccga

SEQ ID NO: 12178 - RNA, 51 nt, Artificial Sequence
  Description of Artificial Sequence: Synthetic oligonucleotide
gggaggacgaugcgggcuucucucguuuuuucccgcagacgacucgcccga

SEQ ID NO: 12179 - RNA, 51 nt, Artificial Sequence
  Description of Artificial Sequence: Synthetic oligonucleotide
gggaggacgaugcggacguuuucuucuauuuaccgcagacgacucgcccga

SEQ ID NO: 12180 - RNA, 51 nt, Artificial Sequence
  Description of Artificial Sequence: Synthetic oligonucleotide
gggaggacgaugcgguuucaucucacuuuuucccgcagacgacucgcccga

SEQ ID NO: 12181 - RNA, 51 nt, Artificial Sequence
  Description of Artificial Sequence: Synthetic oligonucleotide
gggaggacgaugcggguuguuugguuucuuuuccgcagacgacucgcccga

SEQ ID NO: 12182 - RNA, 51 nt, Artificial Sequence
  Description of Artificial Sequence: Synthetic oligonucleotide
gggaggacgaugcgguuuuucauuucaucucuccgcagacgacucgcccga

SEQ ID NO: 12183 - RNA, 51 nt, Artificial Sequence
  Description of Artificial Sequence: Synthetic oligonucleotide
gggaggacgaugcggucauuuucuguuuucuucugcagacgacucgcccga

SEQ ID NO: 12184 - RNA, 51 nt, Artificial Sequence
  Description of Artificial Sequence: Synthetic oligonucleotide
gggaggacgaugcgguucuuguguuuuucuuucugcagacgacucgcccga

SEQ ID NO: 12185 - RNA, 51 nt, Artificial Sequence
  Description of Artificial Sequence: Synthetic oligonucleotide
gggaggacgaugcgguuuuguuuuucuuuuguucccagacgacucgcccga

SEQ ID NO: 12186 - RNA, 51 nt, Artificial Sequence
  Description of Artificial Sequence: Synthetic oligonucleotide
gggaggacgaugcgguucuuguuauuuuuccccugcagacgacucgcccga

SEQ ID NO: 12187 - RNA, 51 nt, Artificial Sequence
  Description of Artificial Sequence: Synthetic oligonucleotide
gggaggacgaugcgggcuuuucuuccuuuuuuccgcagacgacucgcccga

SEQ ID NO: 12188 - RNA, 52 nt, Artificial Sequence
  Description of Artificial Sequence: Synthetic oligonucleotide
gggaggacgaugcggccuuguuuguuuuuuuucccgcagacgacucgcccga

SEQ ID NO: 12189 - RNA, 51 nt, Artificial Sequence
  Description of Artificial Sequence: Synthetic oligonucleotide
gggaggacgaugcggguuucuuaucuuuuuuuccgcagacgacucgcccga

SEQ ID NO: 12190 - RNA, 51 nt, Artificial Sequence
  Description of Artificial Sequence: Synthetic oligonucleotide
gggaggacgaugcggauuauuuucucuauuuacugcagacgacucgcccga

SEQ ID NO: 12191 - RNA, 49 nt, Artificial Sequence
  Description of Artificial Sequence: Synthetic oligonucleotide
gggaggacgaugcgguccugucgucuguguccccagacgacucgcccga

SEQ ID NO: 12192 - RNA, 50 nt, Artificial Sequence
  Description of Artificial Sequence: Synthetic oligonucleotide
gggaggacgaugcgguccugucgucucucguccccagacgacucgcccga

SEQ ID NO: 12193 - RNA, 51 nt, Artificial Sequence
  Description of Artificial Sequence: Synthetic oligonucleotide
gggaggacgaugcgguccuuucguucuacccuccccagacgacucgcccga

SEQ ID NO: 12194 - RNA, 49 nt, Artificial Sequence
  Description of Artificial Sequence: Synthetic oligonucleotide
gggaggacgaugcgguuugggaguaggguuccgcagacgacucgcccga

SEQ ID NO: 12195 - RNA, 51 nt, Artificial Sequence
  Description of Artificial Sequence: Synthetic oligonucleotide
gggaggacgaugcggguugguguagggggguuccccagacgacucgcccga

SEQ ID NO: 12196 - RNA, 51 nt, Artificial Sequence
  Description of Artificial Sequence: Synthetic oligonucleotide
gggaggacgaugcgguuuucguguuuucuauugugcagacgacucgcccga

SEQ ID NO: 12197 - RNA, 52 nt, Artificial Sequence
  Description of Artificial Sequence: Synthetic oligonucleotide
gggaggacgaugcgggccuuucguucuugcccuccccagacgacucgcccga

SEQ ID NO: 12198 - RNA, 51 nt, Artificial Sequence
  Description of Artificial Sequence: Synthetic oligonucleotide
gggaggacgaugcgguaauucuucuuuuugcuccccagacgacucgcccga

SEQ ID NO: 12199 - RNA, 51 nt, Artificial Sequence
  Description of Artificial Sequence: Synthetic oligonucleotide
gggaggacgaugcggucguuguuucuuuuuucccccagacgacucgcccga

SEQ ID NO: 12200 - RNA, 51 nt, Artificial Sequence
  Description of Artificial Sequence: Synthetic oligonucleotide
gggaggacgaugcgguuguuuuuuccuuuucucgccagacgacucgcccga

SEQ ID NO: 12201 - RNA, 51 nt, Artificial Sequence
  Description of Artificial Sequence: Synthetic oligonucleotide
gggaggacgaugcggucauuucucuuccuauuccgcagacgacucgcccga

SEQ ID NO: 12202 - RNA, 52 nt, Artificial Sequence
  Description of Artificial Sequence: Synthetic oligonucleotide
gggaggacgaugcggcuuuuuucuucucuuguuccgcagacgacucgcccga

SEQ ID NO: 12203 - RNA, 51 nt, Artificial Sequence
  Description of Artificial Sequence: Synthetic oligonucleotide
gggaggacgaugcgguuucacuuuuuuuuccccgccagacgacucgcccga

SEQ ID NO: 12204 - RNA, 51 nt, Artificial Sequence
  Description of Artificial Sequence: Synthetic oligonucleotide
gggaggacgaugcggauuuuuucccauuuuuuccgcagacgacucgcccga

SEQ ID NO: 12205 - RNA, 51 nt, Artificial Sequence
  Description of Artificial Sequence: Synthetic oligonucleotide
gggaggacgaugcggcuuaauuugcuuccuuuccgcagacgacucgcccga

SEQ ID NO: 12206 - RNA, 51 nt, Artificial Sequence
  Description of Artificial Sequence: Synthetic oligonucleotide
gggaggacgaugcgggguuuguuuuucuguugccgcagacgacucgcccga

SEQ ID NO: 12207 - RNA, 51 nt, Artificial Sequence
  Description of Artificial Sequence: Synthetic oligonucleotide
gggaggacgaugcggguucuuguaccuuuuuuccgcagacgacucgcccga

SEQ ID NO: 12208 - RNA, 52 nt, Artificial Sequence
  Description of Artificial Sequence: Synthetic oligonucleotide
gggaggacgaugcggucuuuuucauuuuucguuccgcagacgacucgcccga

SEQ ID NO: 12209 - RNA, 51 nt, Artificial Sequence
  Description of Artificial Sequence: Synthetic oligonucleotide
gggaggacgaugcgguuauuucaucuucuuuugugcagacgacucgcccga

SEQ ID NO: 12210 - RNA, 53 nt, Artificial Sequence
  Description of Artificial Sequence: Synthetic oligonucleotide
gggaggacgaugcggguuuacguaccuuuuuuuaccgcagacgacucgcccga

SEQ ID NO: 12211 - RNA, 51 nt, Artificial Sequence
  Description of Artificial Sequence: Synthetic oligonucleotide
gggaggacgaugcggcucuuuuguucuuauuuccgcagacgacucgcccga

SEQ ID NO: 12212 - RNA, 51 nt, Artificial Sequence
  Description of Artificial Sequence: Synthetic oligonucleotide
gggaggacgaugcgguuuuuaaugauuuguucccgcagacgacucgcccga

SEQ ID NO: 12213 - RNA, 51 nt, Artificial Sequence
  Description of Artificial Sequence: Synthetic oligonucleotide
gggaggacgaugcgguuuuuuagauuuuugcuccccagacgacucgcccga

SEQ ID NO: 12214 - RNA, 51 nt, Artificial Sequence
  Description of Artificial Sequence: Synthetic oligonucleotide
gggaggacgaugcgguuucucuuuauaucguuccgcagacgacucgcccga

SEQ ID NO: 12215 - RNA, 51 nt, Artificial Sequence
  Description of Artificial Sequence: Synthetic oligonucleotide
gggaggacgaugcggauuuuuuucuuuuuuugccgcagacgacucgcccga

SEQ ID NO: 12216 - RNA, 51 nt, Artificial Sequence
  Description of Artificial Sequence: Synthetic oligonucleotide
gggaggacgaugcggguucuauacuuuuccuuccgcagacgacucgcccga

SEQ ID NO: 12217 - RNA, 51 nt, Artificial Sequence
  Description of Artificial Sequence: Synthetic oligonucleotide
gggaggacgaugcggguuugcucaacuuuuuuccgcagacgacucgcccga

SEQ ID NO: 12218 - RNA, 51 nt, Artificial Sequence
  Description of Artificial Sequence: Synthetic oligonucleotide
gggaggacgaugcggccauuuuaaauuucucuccgcagacgacucgcccga

SEQ ID NO: 12219 - RNA, 51 nt, Artificial Sequence
  Description of Artificial Sequence: Synthetic oligonucleotide
gggaggacgaugcgguuuuauucuuuuucucccugcagacgacucgcccga

SEQ ID NO: 12220 - RNA, 51 nt, Artificial Sequence
  Description of Artificial Sequence: Synthetic oligonucleotide
gggaggacgaugcggauucuucaucauuucuuccgcagacgacucgcccga

SEQ ID NO: 12221 - RNA, 51 nt, Artificial Sequence
  Description of Artificial Sequence: Synthetic oligonucleotide
gggaggacgaugcggaauauuacuuuuuuuccccgcagacgacucgcccga

SEQ ID NO: 12222 - RNA, 51 nt, Artificial Sequence
  Description of Artificial Sequence: Synthetic oligonucleotide
gggaggacgaugcggacuuguucguuuuuuugcugcagacgacucgcccga

SEQ ID NO: 12223 - RNA, 51 nt, Artificial Sequence
  Description of Artificial Sequence: Synthetic oligonucleotide
gggaggacgaugcgguuuuucuaauuucgcuugugcagacgacucgcccga

SEQ ID NO: 12224 - RNA, 51 nt, Artificial Sequence
  Description of Artificial Sequence: Synthetic oligonucleotide
gggaggacgaugcgguuuuucucuuguuuauugugcagacgacucgcccga

SEQ ID NO: 12225 - RNA, 51 nt, Artificial Sequence
  Description of Artificial Sequence: Synthetic oligonucleotide
gggaggacgaugcgggcuuuuucguucuuuuuccgcagacgacucgcccga

SEQ ID NO: 12226 - RNA, 51 nt, Artificial Sequence
  Description of Artificial Sequence: Synthetic oligonucleotide
gggaggacgaugcggccaucuuuuucuuuuuuccgcagacgacucgcccga

SEQ ID NO: 12227 - RNA, 51 nt, Artificial Sequence
  Description of Artificial Sequence: Synthetic oligonucleotide
gggaggacgaugcgguuuuuauuauuccuguugugcagacgacucgcccga

SEQ ID NO: 12228 - RNA, 51 nt, Artificial Sequence
  Description of Artificial Sequence: Synthetic oligonucleotide
gggaggacgaugcgguuuucuaauuacuuuucccccagacgacucgcccga

SEQ ID NO: 12229 - RNA, 51 nt, Artificial Sequence
  Description of Artificial Sequence: Synthetic oligonucleotide
gggaggacgaugcgguuuuuaucuuucuucuuccgcagacgacucgcccga

SEQ ID NO: 12230 - RNA, 52 nt, Artificial Sequence
  Description of Artificial Sequence: Synthetic oligonucleotide
gggaggacgaugcgguccugucguucuguucguccccagacgacucgcccga

SEQ ID NO: 12231 - RNA, 51 nt, Artificial Sequence
  Description of Artificial Sequence: Synthetic oligonucleotide
gggaggacgaugcgguuuuuuccccuuucuuuccgcagacgacucgcccga

SEQ ID NO: 12232 - RNA, 51 nt, Artificial Sequence
  Description of Artificial Sequence: Synthetic oligonucleotide
gggaggacgaugcggcauuuguucuuauuccuccgcagacgacucgcccga

SEQ ID NO: 12233 - RNA, 51 nt, Artificial Sequence
  Description of Artificial Sequence: Synthetic oligonucleotide
gggaggacgaugcggucucauucacgcuuucuccgcagacgacucgcccga

SEQ ID NO: 12234 - RNA, 51 nt, Artificial Sequence
  Description of Artificial Sequence: Synthetic oligonucleotide
gggaggacgaugcgguucgggaguaggguguuccgcagacgacucgcccga

SEQ ID NO: 12235 - RNA, 51 nt, Artificial Sequence
  Description of Artificial Sequence: Synthetic oligonucleotide
gggaggacgaugcgggauuucgcucauuuuuugcccagacgacucgcccga

SEQ ID NO: 12236 - RNA, 51 nt, Artificial Sequence
  Description of Artificial Sequence: Synthetic oligonucleotide
gggaggacgaugcggguuacuuccuucuuuucccgcagacgacucgcccga

SEQ ID NO: 12237 - RNA, 51 nt, Artificial Sequence
  Description of Artificial Sequence: Synthetic oligonucleotide
gggaggacgaugcgguuuacucucucuuuucuccgcagacgacucgcccga

SEQ ID NO: 12238 - RNA, 51 nt, Artificial Sequence
  Description of Artificial Sequence: Synthetic oligonucleotide
gggaggacgaugcggaccuauucucuuuuucaccgcagacgacucgcccga

SEQ ID NO: 12239 - RNA, 51 nt, Artificial Sequence
  Description of Artificial Sequence: Synthetic oligonucleotide
gggaggacgaugcggucguguuuauuuuuuuuccgcagacgacucgcccga

SEQ ID NO: 12240 - RNA, 51 nt, Artificial Sequence
  Description of Artificial Sequence: Synthetic oligonucleotide
gggaggacgaugcgguuucuguucuuucuucaccgcagacgacucgcccga

SEQ ID NO: 12241 - RNA, 53 nt, Artificial Sequence
  Description of Artificial Sequence: Synthetic oligonucleotide
gggaggacgaugcggucacuuucgcauuuuucuaccgcagacgacucgcccga

SEQ ID NO: 12242 - RNA, 51 nt, Artificial Sequence
  Description of Artificial Sequence: Synthetic oligonucleotide
gggaggacgaugcggcuaucuuuuacuucccuccgcagacgacucgcccga

SEQ ID NO: 12243 - RNA, 51 nt, Artificial Sequence
  Description of Artificial Sequence: Synthetic oligonucleotide
gggaggacgaugcggaauccuuuuucuugucaccgcagacgacucgcccga

SEQ ID NO: 12244 - RNA, 51 nt, Artificial Sequence
  Description of Artificial Sequence: Synthetic oligonucleotide
gggaggacgaugcgguuuuuuguauugcuucuccgcagacgacucgcccga

SEQ ID NO: 12245 - RNA, 52 nt, Artificial Sequence
  Description of Artificial Sequence: Synthetic oligonucleotide
gggaggacgaugcggacauucucuuuuuuuucaccgcagacgacucgcccga

SEQ ID NO: 12246 - RNA, 51 nt, Artificial Sequence
  Description of Artificial Sequence: Synthetic oligonucleotide
gggaggacgaugcggcuuuucgucucuuuuauccgcagacgacucgcccga

SEQ ID NO: 12247 - RNA, 51 nt, Artificial Sequence
  Description of Artificial Sequence: Synthetic oligonucleotide
gggaggacgaugcgguuuuucuuuuauuuccgcgccagacgacucgcccga

SEQ ID NO: 12248 - RNA, 51 nt, Artificial Sequence
  Description of Artificial Sequence: Synthetic oligonucleotide
gggaggacgaugcgguuucauucacguuuuuuccgcagacgacucgcccga

SEQ ID NO: 12249 - RNA, 51 nt, Artificial Sequence
  Description of Artificial Sequence: Synthetic oligonucleotide
gggaggacgaugcggaacuuuuucucuuuuuaccccagacgacucgcccga

SEQ ID NO: 12250 - RNA, 51 nt, Artificial Sequence
  Description of Artificial Sequence: Synthetic oligonucleotide
gggaggacgaugcgguuuucaucaauuuuucuccgcagacgacucgcccga

SEQ ID NO: 12251 - RNA, 51 nt, Artificial Sequence
  Description of Artificial Sequence: Synthetic oligonucleotide
gggaggacgaugcgguuauucuuuucuuauucccccagacgacucgcccga

SEQ ID NO: 12252 - RNA, 51 nt, Artificial Sequence
  Description of Artificial Sequence: Synthetic oligonucleotide
gggaggacgaugcgguuuuuauucuuuuacccccccagacgacucgcccga

SEQ ID NO: 12253 - RNA, 50 nt, Artificial Sequence
  Description of Artificial Sequence: Synthetic oligonucleotide
gggaggacgaugcggcauuuucuacuuuuuuccgcagacgacucgcccga

SEQ ID NO: 12254 - RNA, 51 nt, Artificial Sequence
  Description of Artificial Sequence: Synthetic oligonucleotide
gggaggacgaugcggucuuucgcacuauuuuuccgcagacgacucgcccga

SEQ ID NO: 12255 - RNA, 51 nt, Artificial Sequence
  Description of Artificial Sequence: Synthetic oligonucleotide
gggaggacgaugcggguuuauuuauuguuuuuccgcagacgacucgcccga

SEQ ID NO: 12256 - RNA, 53 nt, Artificial Sequence
  Description of Artificial Sequence: Synthetic oligonucleotide
gggaggacgaugcggauuucacguuguuuuuuuaccgcagacgacucgcccga

SEQ ID NO: 12257 - RNA, 50 nt, Artificial Sequence
  Description of Artificial Sequence: Synthetic oligonucleotide
gggaggacgaugcgguauuuguucuuuuguugcgcagacgacucgcccga

SEQ ID NO: 12258 - RNA, 51 nt, Artificial Sequence
  Description of Artificial Sequence: Synthetic oligonucleotide
gggaggacgaugcgguauuuuuuuccuuuucuccgcagacgacucgcccga

SEQ ID NO: 12259 - RNA, 51 nt, Artificial Sequence
  Description of Artificial Sequence: Synthetic oligonucleotide
gggaggacgaugcgguucuuuauuuuuaccuucgccagacgacucgcccga

SEQ ID NO: 12260 - RNA, 51 nt, Artificial Sequence
  Description of Artificial Sequence: Synthetic oligonucleotide
gggaggacgaugcgguuuuauguuaccuuuuccugcagacgacucgcccga

SEQ ID NO: 12261 - RNA, 50 nt, Artificial Sequence
  Description of Artificial Sequence: Synthetic oligonucleotide
gggaggacgaugcgguuuguuuucucuuuuuccgcagacgacucgcccga

SEQ ID NO: 12262 - RNA, 51 nt, Artificial Sequence
  Description of Artificial Sequence: Synthetic oligonucleotide
gggaggacgaugcgguuuuuuucuauuccuuuccgcagacgacucgcccga

SEQ ID NO: 12263 - RNA, 51 nt, Artificial Sequence
  Description of Artificial Sequence: Synthetic oligonucleotide
gggaggacgaugcgguuuuauuuuugcuuuucccacagacgacucgcccga

SEQ ID NO: 12264 - RNA, 51 nt, Artificial Sequence
  Description of Artificial Sequence: Synthetic oligonucleotide
gggaggacgaugcgguuuauuuucucuuuguugugcagacgacucgcccga

SEQ ID NO: 12265 - RNA, 51 nt, Artificial Sequence
  Description of Artificial Sequence: Synthetic oligonucleotide
gggaggacgaugcgguccugucguucugcccuccccagacgacucgcccga

SEQ ID NO: 12266 - RNA, 51 nt, Artificial Sequence
  Description of Artificial Sequence: Synthetic oligonucleotide
gggaggacgaugcggaccuuacuauuucccuuccgcagacgacucgcccga

SEQ ID NO: 12267 - RNA, 51 nt, Artificial Sequence
  Description of Artificial Sequence: Synthetic oligonucleotide
gggaggacgaugcggcauuuuucucuuuuugugcccagacgacucgcccga

SEQ ID NO: 12268 - RNA, 51 nt, Artificial Sequence
  Description of Artificial Sequence: Synthetic oligonucleotide
gggaggacgaugcgguuuuuugccuucucucuccgcagacgacucgcccga

SEQ ID NO: 12269 - RNA, 52 nt, Artificial Sequence
  Description of Artificial Sequence: Synthetic oligonucleotide
gggaggacgaugcggaauuauguguuuuuuuugugacagacgacucgcccga

SEQ ID NO: 12270 - RNA, 52 nt, Artificial Sequence
  Description of Artificial Sequence: Synthetic oligonucleotide
gggaggacgaugcgguuuauuucuuuccacguuccccagacgacucgcccga

SEQ ID NO: 12271 - RNA, 51 nt, Artificial Sequence
  Description of Artificial Sequence: Synthetic oligonucleotide
gggaggacgaugcggucuuuuccaacuuuuugccgcagacgacucgcccga

SEQ ID NO: 12272 - RNA, 51 nt, Artificial Sequence
  Description of Artificial Sequence: Synthetic oligonucleotide
gggaggacgaugcggacuuuuuaccuuuuccacugcagacgacucgcccga

SEQ ID NO: 12273 - RNA, 52 nt, Artificial Sequence
  Description of Artificial Sequence: Synthetic oligonucleotide
gggaggacgaugcggauuuugcccaguuuuuuaccgcagacgacucgcccga

SEQ ID NO: 12274 - RNA, 51 nt, Artificial Sequence
  Description of Artificial Sequence: Synthetic oligonucleotide
gggaggacgaugcggccuuucuguuuuccucuccgcagacgacucgcccga

SEQ ID NO: 12275 - RNA, 52 nt, Artificial Sequence
  Description of Artificial Sequence: Synthetic oligonucleotide
gggaggacgaugcgguacuuuucuuuuuuuucuccgcagacgacucgcccga

SEQ ID NO: 12276 - RNA, 51 nt, Artificial Sequence
  Description of Artificial Sequence: Synthetic oligonucleotide
gggaggacgaugcgguuucauucucuucuucuccgcagacgacucgcccga

SEQ ID NO: 12277 - RNA, 51 nt, Artificial Sequence
  Description of Artificial Sequence: Synthetic oligonucleotide
gggaggacgaugcggccguuugauuuccuuuuccgcagacgacucgcccga

SEQ ID NO: 12278 - RNA, 52 nt, Artificial Sequence
  Description of Artificial Sequence: Synthetic oligonucleotide
gggaggacgaugcgguauuuacguuuuuuuucaccgcagacgacucgcccga

SEQ ID NO: 12279 - RNA, 51 nt, Artificial Sequence
  Description of Artificial Sequence: Synthetic oligonucleotide
gggaggacgaugcgguuuuuugugguuuguuuccgcagacgacucgcccga

SEQ ID NO: 12280 - RNA, 51 nt, Artificial Sequence
  Description of Artificial Sequence: Synthetic oligonucleotide
gggaggacgaugcgggauuugucuuuucuuuggcccagacgacucgcccga

SEQ ID NO: 12281 - RNA, 51 nt, Artificial Sequence
  Description of Artificial Sequence: Synthetic oligonucleotide
gggaggacgaugcggcuucauuguuucuuuuccgccagacgacucgcccga

SEQ ID NO: 12282 - RNA, 51 nt, Artificial Sequence
  Description of Artificial Sequence: Synthetic oligonucleotide
gggaggacgaugcggccauuucuuuuuuccuuccgcagacgacucgcccga

SEQ ID NO: 12283 - RNA, 51 nt, Artificial Sequence
  Description of Artificial Sequence: Synthetic oligonucleotide
gggaggacgaugcgggguucuuucuuccuuuuccgcagacgacucgcccga

SEQ ID NO: 12284 - RNA, 51 nt, Artificial Sequence
  Description of Artificial Sequence: Synthetic oligonucleotide
gggaggacgaugcgguuuucauuucacuucuugcccagacgacucgcccga

SEQ ID NO: 12285 - RNA, 51 nt, Artificial Sequence
  Description of Artificial Sequence: Synthetic oligonucleotide
gggaggacgaugcggcuuuucacucuaucuuaccgcagacgacucgcccga

SEQ ID NO: 12286 - RNA, 51 nt, Artificial Sequence
  Description of Artificial Sequence: Synthetic oligonucleotide
gggaggacgaugcgguuugggaguagggugucccgcagacgacucgcccga

SEQ ID NO: 12287 - RNA, 51 nt, Artificial Sequence
  Description of Artificial Sequence: Synthetic oligonucleotide
gggaggacgaugcgguauuuuuugcgcuuucuccgcagacgacucgcccga

SEQ ID NO: 12288 - RNA, 51 nt, Artificial Sequence
  Description of Artificial Sequence: Synthetic oligonucleotide
gggaggacgaugcgguuuucuuuguuuaucucccgcagacgacucgcccga

SEQ ID NO: 12289 - RNA, 51 nt, Artificial Sequence
  Description of Artificial Sequence: Synthetic oligonucleotide
gggaggacgaugcgguuuauuauuuuucgcuuccacagacgacucgcccga

SEQ ID NO: 12290 - RNA, 51 nt, Artificial Sequence
  Description of Artificial Sequence: Synthetic oligonucleotide
gggaggacgaugcgguuuuucuuuuucuacguccgcagacgacucgcccga

SEQ ID NO: 12291 - RNA, 53 nt, Artificial Sequence
  Description of Artificial Sequence: Synthetic oligonucleotide
gggaggacgaugcgguaguguuuuuuuuuuuugugcccagacgacucgcccga

SEQ ID NO: 12292 - RNA, 51 nt, Artificial Sequence
  Description of Artificial Sequence: Synthetic oligonucleotide
gggaggacgaugcgguaucucuuguacuucuuccgcagacgacucgcccga

SEQ ID NO: 12293 - RNA, 52 nt, Artificial Sequence
  Description of Artificial Sequence: Synthetic oligonucleotide
gggaggacgaugcgguuuuuuuguucgcuguuucugcagacgacucgcccga

SEQ ID NO: 12294 - RNA, 52 nt, Artificial Sequence
  Description of Artificial Sequence: Synthetic oligonucleotide
gggaggacgaugcgguuuuguucuuuuuuucuuccgcagacgacucgcccga

SEQ ID NO: 12295 - RNA, 51 nt, Artificial Sequence
  Description of Artificial Sequence: Synthetic oligonucleotide
gggaggacgaugcggguuguuucacuuuuucuccgcagacgacucgcccga

SEQ ID NO: 12296 - RNA, 51 nt, Artificial Sequence
  Description of Artificial Sequence: Synthetic oligonucleotide
gggaggacgaugcgguuuuauuccuuucuuuucugcagacgacucgcccga

SEQ ID NO: 12297 - RNA, 51 nt, Artificial Sequence
  Description of Artificial Sequence: Synthetic oligonucleotide
gggaggacgaugcgggauucuacucuuucuccccgcagacgacucgcccga

SEQ ID NO: 12298 - RNA, 51 nt, Artificial Sequence
  Description of Artificial Sequence: Synthetic oligonucleotide
gggaggacgaugcggauuguuucuauuuuuuuccgcagacgacucgcccga

SEQ ID NO: 12299 - RNA, 51 nt, Artificial Sequence
  Description of Artificial Sequence: Synthetic oligonucleotide
gggaggacgaugcggcuuucucacuuuuuuucccgcagacgacucgcccga

SEQ ID NO: 12300 - RNA, 51 nt, Artificial Sequence
  Description of Artificial Sequence: Synthetic oligonucleotide
gggaggacgaugcggauuccacguuuuuauuaccgcagacgacucgcccga

SEQ ID NO: 12301 - RNA, 53 nt, Artificial Sequence
  Description of Artificial Sequence: Synthetic oligonucleotide
gggaggacgaugcgguauuuacguuuuuuuuucaccgcagacgacucgcccga

SEQ ID NO: 12302 - RNA, 51 nt, Artificial Sequence
  Description of Artificial Sequence: Synthetic oligonucleotide
gggaggacgaugcgguuuauuacugucuuuuucugcagacgacucgcccga

SEQ ID NO: 12303 - RNA, 52 nt, Artificial Sequence
  Description of Artificial Sequence: Synthetic oligonucleotide
gggaggacgaugcggccauuuguuuuuuuucuuccgcagacgacucgcccga

SEQ ID NO: 12304 - RNA, 51 nt, Artificial Sequence
  Description of Artificial Sequence: Synthetic oligonucleotide
gggaggacgaugcgguuuuaucacuucuuucgcgucagacgacucgcccga

SEQ ID NO: 12305 - RNA, 51 nt, Artificial Sequence
  Description of Artificial Sequence: Synthetic oligonucleotide
gggaggacgaugcgguuuuuacucugauuuuucugcagacgacucgcccga

SEQ ID NO: 12306 - RNA, 52 nt, Artificial Sequence
  Description of Artificial Sequence: Synthetic oligonucleotide
gggaggacgaugcggucccugucgucuguucguccccagacgacucgcccga

SEQ ID NO: 12307 - RNA, 52 nt, Artificial Sequence
  Description of Artificial Sequence: Synthetic oligonucleotide
gggaggacgaugcgguccuggucgucuguucguccccagacgacucgcccga

SEQ ID NO: 12308 - RNA, 51 nt, Artificial Sequence
  Description of Artificial Sequence: Synthetic oligonucleotide
gggaggacgaugcgguacuuuuguuuguuuugcgccagacgacucgcccga

SEQ ID NO: 12309 - RNA, 51 nt, Artificial Sequence
  Description of Artificial Sequence: Synthetic oligonucleotide
gggaggacgaugcggcacuuuguuuauucccuccgcagacgacucgcccga

SEQ ID NO: 12310 - RNA, 51 nt, Artificial Sequence
  Description of Artificial Sequence: Synthetic oligonucleotide
gggaggacgaugcggucccuuuuguuuuuccccgccagacgacucgcccga

SEQ ID NO: 12311 - RNA, 51 nt, Artificial Sequence
  Description of Artificial Sequence: Synthetic oligonucleotide
gggaggacgaugcgguacucuuuguucccuuuccgcagacgacucgcccga

SEQ ID NO: 12312 - RNA, 53 nt, Artificial Sequence
  Description of Artificial Sequence: Synthetic oligonucleotide
gggaggacgaugcgguuuccuuuuuuuuucccauccgcagacgacucgcccga

SEQ ID NO: 12313 - RNA, 52 nt, Artificial Sequence
  Description of Artificial Sequence: Synthetic oligonucleotide
gggaggacgaugcgguguacucacuuuuuuuguccgcagacgacucgcccga

SEQ ID NO: 12314 - RNA, 51 nt, Artificial Sequence
  Description of Artificial Sequence: Synthetic oligonucleotide
gggaggacgaugcggucuuuuguuauuuccauccgcagacgacucgcccga

SEQ ID NO: 12315 - RNA, 51 nt, Artificial Sequence
  Description of Artificial Sequence: Synthetic oligonucleotide
gggaggacgaugcggcuucuucucucuuaucuccgcagacgacucgcccga

SEQ ID NO: 12316 - RNA, 51 nt, Artificial Sequence
  Description of Artificial Sequence: Synthetic oligonucleotide
gggaggacgaugcggauucuuuuauccuuguuccgcagacgacucgcccga

SEQ ID NO: 12317 - RNA, 51 nt, Artificial Sequence
  Description of Artificial Sequence: Synthetic oligonucleotide
gggaggacgaugcgguuucacacuuuauuuugccgcagacgacucgcccga

SEQ ID NO: 12318 - RNA, 52 nt, Artificial Sequence
  Description of Artificial Sequence: Synthetic oligonucleotide
gggaggacgaugcggugucuuucuaguuuuuugccgcagacgacucgcccga

SEQ ID NO: 12319 - RNA, 52 nt, Artificial Sequence
  Description of Artificial Sequence: Synthetic oligonucleotide
gggaggacgaugcgguuugguuuuuuuuuuugcccgcagacgacucgcccga

SEQ ID NO: 12320 - RNA, 51 nt, Artificial Sequence
  Description of Artificial Sequence: Synthetic oligonucleotide
gggaggacgaugcggaguaucuaucuuuuuugccgcagacgacucgcccga

SEQ ID NO: 12321 - RNA, 51 nt, Artificial Sequence
  Description of Artificial Sequence: Synthetic oligonucleotide
gggaggacgaugcggaucucucuaauucucuuccgcagacgacucgcccga

SEQ ID NO: 12322 - RNA, 51 nt, Artificial Sequence
  Description of Artificial Sequence: Synthetic oligonucleotide
gggaggacgaugcggcuuuuuauuauuucuugccccagacgacucgcccga

SEQ ID NO: 12323 - RNA, 51 nt, Artificial Sequence
  Description of Artificial Sequence: Synthetic oligonucleotide
gggaggacgaugcgguuuucaugacuuauuuuccccagacgacucgcccga

SEQ ID NO: 12324 - RNA, 51 nt, Artificial Sequence
  Description of Artificial Sequence: Synthetic oligonucleotide
gggaggacgaugcggcaccuuuucucuuuuuaccgcagacgacucgcccga

SEQ ID NO: 12325 - RNA, 51 nt, Artificial Sequence
  Description of Artificial Sequence: Synthetic oligonucleotide
gggaggacgaugcggauuugcuacuuuucucaccgcagacgacucgcccga

SEQ ID NO: 12326 - RNA, 51 nt, Artificial Sequence
  Description of Artificial Sequence: Synthetic oligonucleotide
gggaggacgaugcggauuucgcuaauuuuuuaccgcagacgacucgcccga

SEQ ID NO: 12327 - RNA, 51 nt, Artificial Sequence
  Description of Artificial Sequence: Synthetic oligonucleotide
gggaggacgaugcgguuuuucuuucguugcuucugcagacgacucgcccga

SEQ ID NO: 12328 - RNA, 51 nt, Artificial Sequence
  Description of Artificial Sequence: Synthetic oligonucleotide
gggaggacgaugcgguauuuacauuuuuccuugugcagacgacucgcccga

SEQ ID NO: 12329 - RNA, 51 nt, Artificial Sequence
  Description of Artificial Sequence: Synthetic oligonucleotide
gggaggacgaugcggucucuuuuguucuuuuugcccagacgacucgcccga

SEQ ID NO: 12330 - RNA, 51 nt, Artificial Sequence
  Description of Artificial Sequence: Synthetic oligonucleotide
gggaggacgaugcgguuuuauucucuuuucgccaccagacgacucgcccga

SEQ ID NO: 12331 - RNA, 51 nt, Artificial Sequence
  Description of Artificial Sequence: Synthetic oligonucleotide
gggaggacgaugcgguacuuuucuuucucuuucugcagacgacucgcccga

SEQ ID NO: 12332 - RNA, 53 nt, Artificial Sequence
  Description of Artificial Sequence: Synthetic oligonucleotide
gggaggacgaugcggcuuuucauuucuuuuuuuuccgcagacgacucgcccga

SEQ ID NO: 12333 - RNA, 51 nt, Artificial Sequence
  Description of Artificial Sequence: Synthetic oligonucleotide
gggaggacgaugcgguuuuuuuccauuguuuuccgcagacgacucgcccga

SEQ ID NO: 12334 - RNA, 52 nt, Artificial Sequence
  Description of Artificial Sequence: Synthetic oligonucleotide
gggaggacgaugcgguuuuaaguuuuuucguuugugcagacgacucgcccga

SEQ ID NO: 12335 - RNA, 51 nt, Artificial Sequence
  Description of Artificial Sequence: Synthetic oligonucleotide
gggaggacgaugcgguggaguggggaaucgucucccagacgacucgcccga

SEQ ID NO: 12336 - RNA, 51 nt, Artificial Sequence
  Description of Artificial Sequence: Synthetic oligonucleotide
gggaggacgaugcggaauuuuguucuuuuuuugcccagacgacucgcccga

SEQ ID NO: 12337 - RNA, 50 nt, Artificial Sequence
  Description of Artificial Sequence: Synthetic oligonucleotide
gggaggacgaugcgguuuucauucuuuuuucccccagacgacucgcccga

SEQ ID NO: 12338 - RNA, 51 nt, Artificial Sequence
  Description of Artificial Sequence: Synthetic oligonucleotide
gggaggacgaugcgguauuuuaucauuuuucuccgcagacgacucgcccga

SEQ ID NO: 12339 - RNA, 52 nt, Artificial Sequence
  Description of Artificial Sequence: Synthetic oligonucleotide
gggaggacgaugcgguuacuuuguuuuuuuucuccgcagacgacucgcccga

SEQ ID NO: 12340 - RNA, 50 nt, Artificial Sequence
  Description of Artificial Sequence: Synthetic oligonucleotide
gggaggacgaugcgguuuggguuuucccgugccccagacgacucgcccga

SEQ ID NO: 12341 - RNA, 51 nt, Artificial Sequence
  Description of Artificial Sequence: Synthetic oligonucleotide
gggaggacgaugcgguuugggaguuggguguuccgcagacgacucgcccga

SEQ ID NO: 12342 - RNA, 51 nt, Artificial Sequence
  Description of Artificial Sequence: Synthetic oligonucleotide
gggaggacgaugcgguuuggaaguaggguguuccgcagacgacucgcccga

SEQ ID NO: 12343 - RNA, 51 nt, Artificial Sequence
  Description of Artificial Sequence: Synthetic oligonucleotide
gggaggacgaugcgguuaucucuaguuuugcuccgcagacgacucgcccga

SEQ ID NO: 12344 - RNA, 51 nt, Artificial Sequence
  Description of Artificial Sequence: Synthetic oligonucleotide
gggaggacgaugcggauucuucuauuauuguuccgcagacgacucgcccga

SEQ ID NO: 12345 - RNA, 51 nt, Artificial Sequence
  Description of Artificial Sequence: Synthetic oligonucleotide
gggaggacgaugcggcacucuguuuccuuucuccgcagacgacucgcccga

SEQ ID NO: 12346 - RNA, 51 nt, Artificial Sequence
  Description of Artificial Sequence: Synthetic oligonucleotide
gggaggacgaugcgguuugggaggaggggguuccgcagacgacucgcccga

SEQ ID NO: 12347 - RNA, 51 nt, Artificial Sequence
  Description of Artificial Sequence: Synthetic oligonucleotide
gggaggacgaugcgguuuuucgacuuucugcuccgcagacgacucgcccga

SEQ ID NO: 12348 - RNA, 51 nt, Artificial Sequence
  Description of Artificial Sequence: Synthetic oligonucleotide
gggaggacgaugcggcguuuuauucuuuuuucgcccagacgacucgcccga

SEQ ID NO: 12349 - RNA, 51 nt, Artificial Sequence
  Description of Artificial Sequence: Synthetic oligonucleotide
gggaggacgaugcggucauuuucuacuuuuucccgcagacgacucgcccga

SEQ ID NO: 12350 - RNA, 51 nt, Artificial Sequence
  Description of Artificial Sequence: Synthetic oligonucleotide
gggaggacgaugcggccauuuuuucuuucuuuccgcagacgacucgcccga

SEQ ID NO: 12351 - RNA, 51 nt, Artificial Sequence
  Description of Artificial Sequence: Synthetic oligonucleotide
gggaggacgaugcgguuuucauugcucacucuccgcagacgacucgcccga

SEQ ID NO: 12352 - RNA, 51 nt, Artificial Sequence
  Description of Artificial Sequence: Synthetic oligonucleotide
gggaggacgaugcggcuguauguugguagccacgccagacgacucgcccga

SEQ ID NO: 12353 - RNA, 51 nt, Artificial Sequence
  Description of Artificial Sequence: Synthetic oligonucleotide
gggaggacgaugcgguuucuucuacuucucguccgcagacgacucgcccga

SEQ ID NO: 12354 - RNA, 51 nt, Artificial Sequence
  Description of Artificial Sequence: Synthetic oligonucleotide
gggaggacgaugcggguuuacuucuucuuuccccgcagacgacucgcccga

SEQ ID NO: 12355 - RNA, 51 nt, Artificial Sequence
  Description of Artificial Sequence: Synthetic oligonucleotide
gggaggacgaugcgguuuuauccuuuauuucccugcagacgacucgcccga

SEQ ID NO: 12356 - RNA, 51 nt, Artificial Sequence
  Description of Artificial Sequence: Synthetic oligonucleotide
gggaggacgaugcgguguuuauuaucuuuuuucgccagacgacucgcccga

SEQ ID NO: 12357 - RNA, 51 nt, Artificial Sequence
  Description of Artificial Sequence: Synthetic oligonucleotide
gggaggacgaugcggcuuuuuagcuucuuuuaccgcagacgacucgcccga

SEQ ID NO: 12358 - RNA, 49 nt, Artificial Sequence
  Description of Artificial Sequence: Synthetic oligonucleotide
gggaggacgaugcgggccuuguucugcccuccccagacgacucgcccga

SEQ ID NO: 12359 - RNA, 51 nt, Artificial Sequence
  Description of Artificial Sequence: Synthetic oligonucleotide
gggaggacgaugcgguuuucuacuuuccuauugugcagacgacucgcccga

SEQ ID NO: 12360 - RNA, 52 nt, Artificial Sequence
  Description of Artificial Sequence: Synthetic oligonucleotide
gggaggacgaugcggacuuguucguuuuuuuugcugcagacgacucgcccga

SEQ ID NO: 12361 - RNA, 51 nt, Artificial Sequence
  Description of Artificial Sequence: Synthetic oligonucleotide
gggaggacgaugcggacuuuuuaucuugcuuaccccagacgacucgcccga

SEQ ID NO: 12362 - RNA, 51 nt, Artificial Sequence
  Description of Artificial Sequence: Synthetic oligonucleotide
gggaggacgaugcgguuuacuuuuuauuuugcgcccagacgacucgcccga

SEQ ID NO: 12363 - RNA, 51 nt, Artificial Sequence
  Description of Artificial Sequence: Synthetic oligonucleotide
gggaggacgaugcgguuuuuacauguuuucucccgcagacgacucgcccga

SEQ ID NO: 12364 - RNA, 53 nt, Artificial Sequence
  Description of Artificial Sequence: Synthetic oligonucleotide
gggaggacgaugcgguuuuacuucuuuuuuuucgcaucagacgacucgcccga

SEQ ID NO: 12365 - RNA, 51 nt, Artificial Sequence
  Description of Artificial Sequence: Synthetic oligonucleotide
gggaggacgaugcggauuuaucuauuuuuuugcugcagacgacucgcccga

SEQ ID NO: 12366 - RNA, 51 nt, Artificial Sequence
  Description of Artificial Sequence: Synthetic oligonucleotide
gggaggacgaugcggaucauuuucuauucuucccgcagacgacucgcccga

SEQ ID NO: 12367 - RNA, 51 nt, Artificial Sequence
  Description of Artificial Sequence: Synthetic oligonucleotide
gggaggacgaugcgguuucguaauaccuuuuuccgcagacgacucgcccga

SEQ ID NO: 12368 - RNA, 51 nt, Artificial Sequence
  Description of Artificial Sequence: Synthetic oligonucleotide
gggaggacgaugcgguuuuuuguacuuucuucccgcagacgacucgcccga

SEQ ID NO: 12369 - RNA, 52 nt, Artificial Sequence
  Description of Artificial Sequence: Synthetic oligonucleotide
gggaggacgaugcgguuucuuuucauuuuuuuuccgcagacgacucgcccga

SEQ ID NO: 12370 - RNA, 51 nt, Artificial Sequence
  Description of Artificial Sequence: Synthetic oligonucleotide
gggaggacgaugcgguuucuauuauuucuuaucugcagacgacucgcccga

SEQ ID NO: 12371 - RNA, 51 nt, Artificial Sequence
  Description of Artificial Sequence: Synthetic oligonucleotide
gggaggacgaugcggauuucuuuuaauucuugccccagacgacucgcccga

SEQ ID NO: 12372 - RNA, 50 nt, Artificial Sequence
  Description of Artificial Sequence: Synthetic oligonucleotide
gggaggacgaugcggcuuuucauuuauuuuaccgcagacgacucgcccga

SEQ ID NO: 12373 - RNA, 51 nt, Artificial Sequence
  Description of Artificial Sequence: Synthetic oligonucleotide
gggaggacgaugcgguuuuauuuuaugcguuuccccagacgacucgcccga

SEQ ID NO: 12374 - RNA, 51 nt, Artificial Sequence
  Description of Artificial Sequence: Synthetic oligonucleotide
gggaggacgaugcgguuuaucaucauuucuuuccgcagacgacucgcccga

SEQ ID NO: 12375 - RNA, 51 nt, Artificial Sequence
  Description of Artificial Sequence: Synthetic oligonucleotide
gggaggacgaugcggcuauuuuuuccuuuuuuccgcagacgacucgcccga

SEQ ID NO: 12376 - RNA, 51 nt, Artificial Sequence
  Description of Artificial Sequence: Synthetic oligonucleotide
gggaggacgaugcggauuuuuucuauuucuuaccgcagacgacucgcccga

SEQ ID NO: 12377 - RNA, 52 nt, Artificial Sequence
  Description of Artificial Sequence: Synthetic oligonucleotide
gggaggacgaugcgguaguguuuuuuuuuuugugcccagacgacucgcccga

SEQ ID NO: 12378 - RNA, 51 nt, Artificial Sequence
  Description of Artificial Sequence: Synthetic oligonucleotide
gggaggacgaugcgggucuuaucuucuuuuuaccgcagacgacucgcccga

SEQ ID NO: 12379 - RNA, 51 nt, Artificial Sequence
  Description of Artificial Sequence: Synthetic oligonucleotide
gggaggacgaugcggcauuuuuucauuuuucuccgcagacgacucgcccga

SEQ ID NO: 12380 - RNA, 51 nt, Artificial Sequence
  Description of Artificial Sequence: Synthetic oligonucleotide
gggaggacgaugcgguauucuuuuauucucuugugcagacgacucgcccga

SEQ ID NO: 12381 - RNA, 51 nt, Artificial Sequence
  Description of Artificial Sequence: Synthetic oligonucleotide
gggaggacgaugcggucacuacaauuuucccuccgcagacgacucgcccga

SEQ ID NO: 12382 - RNA, 50 nt, Artificial Sequence
  Description of Artificial Sequence: Synthetic oligonucleotide
gggaggacgaugcgggauacuuuuuuuuugcccccagacgacucgcccga

SEQ ID NO: 12383 - RNA, 51 nt, Artificial Sequence
  Description of Artificial Sequence: Synthetic oligonucleotide
gggaggacgaugcggaccacuuuucucuuuuuccgcagacgacucgcccga

SEQ ID NO: 12384 - RNA, 51 nt, Artificial Sequence
  Description of Artificial Sequence: Synthetic oligonucleotide
gggaggacgaugcggacucacuuuuucuucuuccgcagacgacucgcccga

SEQ ID NO: 12385 - RNA, 51 nt, Artificial Sequence
  Description of Artificial Sequence: Synthetic oligonucleotide
gggaggacgaugcggucuuuuacuuguccacuccgcagacgacucgcccga

SEQ ID NO: 12386 - RNA, 51 nt, Artificial Sequence
  Description of Artificial Sequence: Synthetic oligonucleotide
gggaggacgaugcgguuaucuucuucauugcuccgcagacgacucgcccga

SEQ ID NO: 12387 - RNA, 51 nt, Artificial Sequence
  Description of Artificial Sequence: Synthetic oligonucleotide
gggaggacgaugcggggcuuuucuucuuuuugccgcagacgacucgcccga

SEQ ID NO: 12388 - RNA, 51 nt, Artificial Sequence
  Description of Artificial Sequence: Synthetic oligonucleotide
gggaggacgaugcggcuuuuucucuuuuugugccgcagacgacucgcccga

SEQ ID NO: 12389 - RNA, 51 nt, Artificial Sequence
  Description of Artificial Sequence: Synthetic oligonucleotide
gggaggacgaugcggauuuauuuuuuugcgccccgcagacgacucgcccga

SEQ ID NO: 12390 - RNA, 51 nt, Artificial Sequence
  Description of Artificial Sequence: Synthetic oligonucleotide
gggaggacgaugcgguuuuuccuacacuuauuccgcagacgacucgcccga

SEQ ID NO: 12391 - RNA, 51 nt, Artificial Sequence
  Description of Artificial Sequence: Synthetic oligonucleotide
gggaggacgaugcggccaucucuuuuuuuccuccgcagacgacucgcccga

SEQ ID NO: 12392 - RNA, 51 nt, Artificial Sequence
  Description of Artificial Sequence: Synthetic oligonucleotide
gggaggacgaugcgguucuacuuucuuuucauccgcagacgacucgcccga

SEQ ID NO: 12393 - RNA, 51 nt, Artificial Sequence
  Description of Artificial Sequence: Synthetic oligonucleotide
gggaggacgaugcggcucauuaauucuuuucuccgcagacgacucgcccga

SEQ ID NO: 12394 - RNA, 51 nt, Artificial Sequence
  Description of Artificial Sequence: Synthetic oligonucleotide
gggaggacgaugcggcuuuuuuucgccuauuuccgcagacgacucgcccga

SEQ ID NO: 12395 - RNA, 51 nt, Artificial Sequence
  Description of Artificial Sequence: Synthetic oligonucleotide
gggaggacgaugcggcucuuuacuuuucuucuccgcagacgacucgcccga

SEQ ID NO: 12396 - RNA, 51 nt, Artificial Sequence
  Description of Artificial Sequence: Synthetic oligonucleotide
gggaggacgaugcgguuugggcguaggguguuccgcagacgacucgcccga

SEQ ID NO: 12397 - RNA, 51 nt, Artificial Sequence
  Description of Artificial Sequence: Synthetic oligonucleotide
gggaggacgaugcgguuccuuuuuccuuugcuccgcagacgacucgcccga

SEQ ID NO: 12398 - RNA, 51 nt, Artificial Sequence
  Description of Artificial Sequence: Synthetic oligonucleotide
gggaggacgaugcggucauuauucuuucacauccgcagacgacucgcccga

SEQ ID NO: 12399 - RNA, 51 nt, Artificial Sequence
  Description of Artificial Sequence: Synthetic oligonucleotide
gggaggacgaugcgguuucucacuaauccuuuccgcagacgacucgcccga

SEQ ID NO: 12400 - RNA, 50 nt, Artificial Sequence
  Description of Artificial Sequence: Synthetic oligonucleotide
gggaggacgaugcggauuccacuuuuuuucaccgcagacgacucgcccga

SEQ ID NO: 12401 - RNA, 53 nt, Artificial Sequence
  Description of Artificial Sequence: Synthetic oligonucleotide
gggaggacgaugcggcauuauuucuucucgcuauccgcagacgacucgcccga

SEQ ID NO: 12402 - RNA, 51 nt, Artificial Sequence
  Description of Artificial Sequence: Synthetic oligonucleotide
gggaggacgaugcggacuuuacaucauuuuuaccgcagacgacucgcccga

SEQ ID NO: 12403 - RNA, 51 nt, Artificial Sequence
  Description of Artificial Sequence: Synthetic oligonucleotide
gggaggacgaugcggaccuuauuucuuuuuugcugcagacgacucgcccga

SEQ ID NO: 12404 - RNA, 52 nt, Artificial Sequence
  Description of Artificial Sequence: Synthetic oligonucleotide
gggaggacgaugcggcuuucacuuuuuuucucuccucagacgacucgcccga

SEQ ID NO: 12405 - RNA, 51 nt, Artificial Sequence
  Description of Artificial Sequence: Synthetic oligonucleotide
gggaggacgaugcgguuuucuuuucuuccuuucugcagacgacucgcccga

SEQ ID NO: 12406 - RNA, 51 nt, Artificial Sequence
  Description of Artificial Sequence: Synthetic oligonucleotide
gggaggacgaugcgguuuuucuguuucguuuuccgcagacgacucgcccga

SEQ ID NO: 12407 - RNA, 51 nt, Artificial Sequence
  Description of Artificial Sequence: Synthetic oligonucleotide
gggaggacgaugcgguuucuuuauuuuuugugcgccagacgacucgcccga

SEQ ID NO: 12408 - RNA, 51 nt, Artificial Sequence
  Description of Artificial Sequence: Synthetic oligonucleotide
gggaggacgaugcgguuucaucuuuuuuuuuuccgcagacgacucgcccga

SEQ ID NO: 12409 - RNA, 51 nt, Artificial Sequence
  Description of Artificial Sequence: Synthetic oligonucleotide
gggaggacgaugcgguuuccgucuuucauuuuccgcagacgacucgcccga

SEQ ID NO: 12410 - RNA, 51 nt, Artificial Sequence
  Description of Artificial Sequence: Synthetic oligonucleotide
gggaggacgaugcggcuuuauauugcacuuuuccgcagacgacucgcccga

SEQ ID NO: 12411 - RNA, 51 nt, Artificial Sequence
  Description of Artificial Sequence: Synthetic oligonucleotide
gggaggacgaugcggucuucauauuuacucuuccgcagacgacucgcccga

SEQ ID NO: 12412 - RNA, 51 nt, Artificial Sequence
  Description of Artificial Sequence: Synthetic oligonucleotide
gggaggacgaugcgguuacuuuuaauuucuuuccgcagacgacucgcccga

SEQ ID NO: 12413 - RNA, 52 nt, Artificial Sequence
  Description of Artificial Sequence: Synthetic oligonucleotide
gggaggacgaugcggucuuuuuucauuaucuccccgcagacgacucgcccga

SEQ ID NO: 12414 - RNA, 51 nt, Artificial Sequence
  Description of Artificial Sequence: Synthetic oligonucleotide
gggaggacgaugcgguuuuuucuuuuugccuuccgcagacgacucgcccga

SEQ ID NO: 12415 - RNA, 50 nt, Artificial Sequence
  Description of Artificial Sequence: Synthetic oligonucleotide
gggaggacgaugcggauucucuuuuuucccaccgcagacgacucgcccga

SEQ ID NO: 12416 - RNA, 51 nt, Artificial Sequence
  Description of Artificial Sequence: Synthetic oligonucleotide
gggaggacgaugcgguuuuauuucaaucuucugugcagacgacucgcccga

SEQ ID NO: 12417 - RNA, 51 nt, Artificial Sequence
  Description of Artificial Sequence: Synthetic oligonucleotide
gggaggacgaugcgguuuacuuuuuacuuuccccacagacgacucgcccga

SEQ ID NO: 12418 - RNA, 50 nt, Artificial Sequence
  Description of Artificial Sequence: Synthetic oligonucleotide
gggaggacgaugcggcuuucgcuuuuauuuuccgcagacgacucgcccga

SEQ ID NO: 12419 - RNA, 52 nt, Artificial Sequence
  Description of Artificial Sequence: Synthetic oligonucleotide
gggaggacgaugcgguuuucucuaaauuuuucuccgcagacgacucgcccga

SEQ ID NO: 12420 - RNA, 51 nt, Artificial Sequence
  Description of Artificial Sequence: Synthetic oligonucleotide
gggaggacgaugcggcuuuacuuucuuauuucccccagacgacucgcccga

SEQ ID NO: 12421 - RNA, 51 nt, Artificial Sequence
  Description of Artificial Sequence: Synthetic oligonucleotide
gggaggacgaugcgguuguuuauuuuuguuauccccagacgacucgcccga

SEQ ID NO: 12422 - RNA, 51 nt, Artificial Sequence
  Description of Artificial Sequence: Synthetic oligonucleotide
gggaggacgaugcgguucgcuuauauuuuuuuccgcagacgacucgcccga

SEQ ID NO: 12423 - RNA, 53 nt, Artificial Sequence
  Description of Artificial Sequence: Synthetic oligonucleotide
gggaggacgaugcggucuuuuuuuuuguguuucuccgcagacgacucgcccga

SEQ ID NO: 12424 - RNA, 53 nt, Artificial Sequence
  Description of Artificial Sequence: Synthetic oligonucleotide
gggaggacgaugcgguuugggguuuuuucccgugccccagacgacucgcccga

SEQ ID NO: 12425 - RNA, 52 nt, Artificial Sequence
  Description of Artificial Sequence: Synthetic oligonucleotide
gggaggacgaugcgguccuguucgucuguucguccccagacgacucgcccga

SEQ ID NO: 12426 - RNA, 50 nt, Artificial Sequence
  Description of Artificial Sequence: Synthetic oligonucleotide
gggaggacgaugcgguuugggaguaggguguucgcagacgacucgcccga

SEQ ID NO: 12427 - RNA, 51 nt, Artificial Sequence
  Description of Artificial Sequence: Synthetic oligonucleotide
gggaggacgaugcggauuuauguuuuuucuugccgcagacgacucgcccga

SEQ ID NO: 12428 - RNA, 51 nt, Artificial Sequence
  Description of Artificial Sequence: Synthetic oligonucleotide
gggaggacgaugcggaauucuuaucuuuuuggccgcagacgacucgcccga

SEQ ID NO: 12429 - RNA, 51 nt, Artificial Sequence
  Description of Artificial Sequence: Synthetic oligonucleotide
gggaggacgaugcggcuuuuccuauccuuucaccgcagacgacucgcccga

SEQ ID NO: 12430 - RNA, 53 nt, Artificial Sequence
  Description of Artificial Sequence: Synthetic oligonucleotide
gggaggacgaugcggauucguuuuuuuucuuguuccgcagacgacucgcccga

SEQ ID NO: 12431 - RNA, 49 nt, Artificial Sequence
  Description of Artificial Sequence: Synthetic oligonucleotide
gggaggacgaugcggauuacucuucucuugccgcagacgacucgcccga

SEQ ID NO: 12432 - RNA, 52 nt, Artificial Sequence
  Description of Artificial Sequence: Synthetic oligonucleotide
gggaggacgaugcgguguuuuuuuucccuuuccccgcagacgacucgcccga

SEQ ID NO: 12433 - RNA, 51 nt, Artificial Sequence
  Description of Artificial Sequence: Synthetic oligonucleotide
gggaggacgaugcgguuucuuugcauuucuauccgcagacgacucgcccga

SEQ ID NO: 12434 - RNA, 53 nt, Artificial Sequence
  Description of Artificial Sequence: Synthetic oligonucleotide
gggaggacgaugcggauuuucucuuuuuuuucugccgcagacgacucgcccga

SEQ ID NO: 12435 - RNA, 51 nt, Artificial Sequence
  Description of Artificial Sequence: Synthetic oligonucleotide
gggaggacgaugcggaucucgcucaauuuucuccgcagacgacucgcccga

SEQ ID NO: 12436 - RNA, 51 nt, Artificial Sequence
  Description of Artificial Sequence: Synthetic oligonucleotide
gggaggacgaugcgguucuuuacaucuccuuuccgcagacgacucgcccga

SEQ ID NO: 12437 - RNA, 51 nt, Artificial Sequence
  Description of Artificial Sequence: Synthetic oligonucleotide
gggaggacgaugcggucuuucucucuuuugcuccgcagacgacucgcccga

SEQ ID NO: 12438 - RNA, 51 nt, Artificial Sequence
  Description of Artificial Sequence: Synthetic oligonucleotide
gggaggacgaugcgguuccuauuucguucuuuccgcagacgacucgcccga

SEQ ID NO: 12439 - RNA, 51 nt, Artificial Sequence
  Description of Artificial Sequence: Synthetic oligonucleotide
gggaggacgaugcgguuacuuucuuuuucccaccccagacgacucgcccga

SEQ ID NO: 12440 - RNA, 51 nt, Artificial Sequence
  Description of Artificial Sequence: Synthetic oligonucleotide
gggaggacgaugcggcucuuucuuuuauccuuccgcagacgacucgcccga

SEQ ID NO: 12441 - RNA, 51 nt, Artificial Sequence
  Description of Artificial Sequence: Synthetic oligonucleotide
gggaggacgaugcggcauuauuuuuuuucccucggcagacgacucgcccga

SEQ ID NO: 12442 - RNA, 51 nt, Artificial Sequence
  Description of Artificial Sequence: Synthetic oligonucleotide
gggaggacgaugcggacuuuucuugguuuuucccgcagacgacucgcccga

SEQ ID NO: 12443 - RNA, 51 nt, Artificial Sequence
  Description of Artificial Sequence: Synthetic oligonucleotide
gggaggacgaugcggucuuuuuuguuuuucugccgcagacgacucgcccga

SEQ ID NO: 12444 - RNA, 51 nt, Artificial Sequence
  Description of Artificial Sequence: Synthetic oligonucleotide
gggaggacgaugcgguuuuucacuaugcuuuucugcagacgacucgcccga

SEQ ID NO: 12445 - RNA, 51 nt, Artificial Sequence
  Description of Artificial Sequence: Synthetic oligonucleotide
gggaggacgaugcgguauuuuuucuucuucuugugcagacgacucgcccga

SEQ ID NO: 12446 - RNA, 51 nt, Artificial Sequence
  Description of Artificial Sequence: Synthetic oligonucleotide
gggaggacgaugcgguucuuguucuuauucauccgcagacgacucgcccga

SEQ ID NO: 12447 - RNA, 51 nt, Artificial Sequence
  Description of Artificial Sequence: Synthetic oligonucleotide
gggaggacgaugcggucuuuacuuaaauuucuccgcagacgacucgcccga

SEQ ID NO: 12448 - RNA, 51 nt, Artificial Sequence
  Description of Artificial Sequence: Synthetic oligonucleotide
gggaggacgaugcgguucucuauuuguucuuuccgcagacgacucgcccga

SEQ ID NO: 12449 - RNA, 53 nt, Artificial Sequence
  Description of Artificial Sequence: Synthetic oligonucleotide
gggaggacgaugcggaauugcucuuuuuuuucuaccgcagacgacucgcccga

SEQ ID NO: 12450 - RNA, 51 nt, Artificial Sequence
  Description of Artificial Sequence: Synthetic oligonucleotide
gggaggacgaugcggauauuucacguuuuuuacugcagacgacucgcccga

SEQ ID NO: 12451 - RNA, 51 nt, Artificial Sequence
  Description of Artificial Sequence: Synthetic oligonucleotide
gggaggacgaugcggauuuucaguuuguuucaccgcagacgacucgcccga

SEQ ID NO: 12452 - RNA, 51 nt, Artificial Sequence
  Description of Artificial Sequence: Synthetic oligonucleotide
gggaggacgaugcggcuucucuacuuuucuuuccgcagacgacucgcccga

SEQ ID NO: 12453 - RNA, 51 nt, Artificial Sequence
  Description of Artificial Sequence: Synthetic oligonucleotide
gggaggacgaugcggacuuuuuacuucuuucaccgcagacgacucgcccga

SEQ ID NO: 12454 - RNA, 51 nt, Artificial Sequence
  Description of Artificial Sequence: Synthetic oligonucleotide
gggaggacgaugcgguuucuauuuuauuuugugugcagacgacucgcccga

SEQ ID NO: 12455 - RNA, 51 nt, Artificial Sequence
  Description of Artificial Sequence: Synthetic oligonucleotide
gggaggacgaugcgguuuuacuuuagcuuuuuccccagacgacucgcccga

SEQ ID NO: 12456 - RNA, 51 nt, Artificial Sequence
  Description of Artificial Sequence: Synthetic oligonucleotide
gggaggacgaugcgguucauuuuuuauucccugugcagacgacucgcccga

SEQ ID NO: 12457 - RNA, 51 nt, Artificial Sequence
  Description of Artificial Sequence: Synthetic oligonucleotide
gggaggacgaugcggacuuuuucuuucuuaucccccagacgacucgcccga

SEQ ID NO: 12458 - RNA, 51 nt, Artificial Sequence
  Description of Artificial Sequence: Synthetic oligonucleotide
gggaggacgaugcgguuuuaucuuuuucauuuccccagacgacucgcccga

SEQ ID NO: 12459 - RNA, 51 nt, Artificial Sequence
  Description of Artificial Sequence: Synthetic oligonucleotide
gggaggacgaugcgggucuuacuauuucuuuuccgcagacgacucgcccga

SEQ ID NO: 12460 - RNA, 52 nt, Artificial Sequence
  Description of Artificial Sequence: Synthetic oligonucleotide
gggaggacgaugcggucuuuuuuuuuguuucccccgcagacgacucgcccga

SEQ ID NO: 12461 - RNA, 51 nt, Artificial Sequence
  Description of Artificial Sequence: Synthetic oligonucleotide
gggaggacgaugcgguuuuauucuuuccuuuacgccagacgacucgcccga

SEQ ID NO: 12462 - RNA, 51 nt, Artificial Sequence
  Description of Artificial Sequence: Synthetic oligonucleotide
gggaggacgaugcgguuuuucucuuccuuuguccgcagacgacucgcccga

SEQ ID NO: 12463 - RNA, 53 nt, Artificial Sequence
  Description of Artificial Sequence: Synthetic oligonucleotide
gggaggacgaugcggauucggucuuuuuuuugcuccgcagacgacucgcccga

SEQ ID NO: 12464 - RNA, 51 nt, Artificial Sequence
  Description of Artificial Sequence: Synthetic oligonucleotide
gggaggacgaugcggauugggaguaggguguuccgcagacgacucgcccga

SEQ ID NO: 12465 - RNA, 51 nt, Artificial Sequence
  Description of Artificial Sequence: Synthetic oligonucleotide
gggaggacgaugcggauuauauucucucucugccgcagacgacucgcccga

SEQ ID NO: 12466 - RNA, 52 nt, Artificial Sequence
  Description of Artificial Sequence: Synthetic oligonucleotide
gggaggacgaugcggacuucuuuuuuuguuuugccgcagacgacucgcccga

SEQ ID NO: 12467 - RNA, 51 nt, Artificial Sequence
  Description of Artificial Sequence: Synthetic oligonucleotide
gggaggacgaugcggguuuaucuccuuuuuugccccagacgacucgcccga

SEQ ID NO: 12468 - RNA, 51 nt, Artificial Sequence
  Description of Artificial Sequence: Synthetic oligonucleotide
gggaggacgaugcgguucucuguuccuuucugccgcagacgacucgcccga

SEQ ID NO: 12469 - RNA, 51 nt, Artificial Sequence
  Description of Artificial Sequence: Synthetic oligonucleotide
gggaggacgaugcgggauggugguguaggguaccgcagacgacucgcccga

SEQ ID NO: 12470 - RNA, 51 nt, Artificial Sequence
  Description of Artificial Sequence: Synthetic oligonucleotide
gggaggacgaugcgguuucuuacuuccucguuccgcagacgacucgcccga

SEQ ID NO: 12471 - RNA, 51 nt, Artificial Sequence
  Description of Artificial Sequence: Synthetic oligonucleotide
gggaggacgaugcgguuuuucucucuacauuuccgcagacgacucgcccga

SEQ ID NO: 12472 - RNA, 51 nt, Artificial Sequence
  Description of Artificial Sequence: Synthetic oligonucleotide
gggaggacgaugcgguuauuuuccgccuuuugccgcagacgacucgcccga

SEQ ID NO: 12473 - RNA, 51 nt, Artificial Sequence
  Description of Artificial Sequence: Synthetic oligonucleotide
gggaggacgaugcgguucucuauuuuuucuugccgcagacgacucgcccga

SEQ ID NO: 12474 - RNA, 51 nt, Artificial Sequence
  Description of Artificial Sequence: Synthetic oligonucleotide
gggaggacgaugcggacauuauccugcauguaccgcagacgacucgcccga

SEQ ID NO: 12475 - RNA, 52 nt, Artificial Sequence
  Description of Artificial Sequence: Synthetic oligonucleotide
gggaggacgaugcggaucuuucuuucuuucuguccgcagacgacucgcccga

SEQ ID NO: 12476 - RNA, 51 nt, Artificial Sequence
  Description of Artificial Sequence: Synthetic oligonucleotide
gggaggacgaugcgguuuucuauuuguugcuuccgcagacgacucgcccga

SEQ ID NO: 12477 - RNA, 51 nt, Artificial Sequence
  Description of Artificial Sequence: Synthetic oligonucleotide
gggaggacgaugcgguuuacauuuucuccucuccgcagacgacucgcccga

SEQ ID NO: 12478 - RNA, 51 nt, Artificial Sequence
  Description of Artificial Sequence: Synthetic oligonucleotide
gggaggacgaugcgguauucuuauguuacuuuccgcagacgacucgcccga

SEQ ID NO: 12479 - RNA, 50 nt, Artificial Sequence
  Description of Artificial Sequence: Synthetic oligonucleotide
gggaggacgaugcggcauucuuuuuucuccugugcagacgacucgcccga

SEQ ID NO: 12480 - RNA, 51 nt, Artificial Sequence
  Description of Artificial Sequence: Synthetic oligonucleotide
gggaggacgaugcggcuuuauuuucgguuuuaccgcagacgacucgcccga

SEQ ID NO: 12481 - RNA, 51 nt, Artificial Sequence
  Description of Artificial Sequence: Synthetic oligonucleotide
gggaggacgaugcggcucuuuuuucuccauauccgcagacgacucgcccga

SEQ ID NO: 12482 - RNA, 51 nt, Artificial Sequence
  Description of Artificial Sequence: Synthetic oligonucleotide
gggaggacgaugcggcucucucuuuguuuucuccgcagacgacucgcccga

SEQ ID NO: 12483 - RNA, 50 nt, Artificial Sequence
  Description of Artificial Sequence: Synthetic oligonucleotide
gggaggacgaugcggauucuuguuuuuuuugccgcagacgacucgcccga

SEQ ID NO: 12484 - RNA, 51 nt, Artificial Sequence
  Description of Artificial Sequence: Synthetic oligonucleotide
gggaggacgaugcggauucguuuuuucuuguuccgcagacgacucgcccga

SEQ ID NO: 12485 - RNA, 51 nt, Artificial Sequence
  Description of Artificial Sequence: Synthetic oligonucleotide
gggaggacgaugcggauuuucccuuucuuacuccgcagacgacucgcccga

SEQ ID NO: 12486 - RNA, 53 nt, Artificial Sequence
  Description of Artificial Sequence: Synthetic oligonucleotide
gggaggacgaugcggcuuuauuuuuuguuuuuugccccagacgacucgcccga

SEQ ID NO: 12487 - RNA, 51 nt, Artificial Sequence
  Description of Artificial Sequence: Synthetic oligonucleotide
gggaggacgaugcgguuugggaguaggguguuccacagacgacucgcccga

SEQ ID NO: 12488 - RNA, 51 nt, Artificial Sequence
  Description of Artificial Sequence: Synthetic oligonucleotide
gggaggacgaugcgguuuuuccuuuccuuuguccgcagacgacucgcccga

SEQ ID NO: 12489 - RNA, 51 nt, Artificial Sequence
  Description of Artificial Sequence: Synthetic oligonucleotide
gggaggacgaugcggaccuuuaauuacuccuuccgcagacgacucgcccga

SEQ ID NO: 12490 - RNA, 50 nt, Artificial Sequence
  Description of Artificial Sequence: Synthetic oligonucleotide
gggaggacgaugcgguuuccacgguuuuuuuccgcagacgacucgcccga

SEQ ID NO: 12491 - RNA, 51 nt, Artificial Sequence
  Description of Artificial Sequence: Synthetic oligonucleotide
gggaggacgaugcgguucuuuauaauuauucuccgcagacgacucgcccga

SEQ ID NO: 12492 - RNA, 51 nt, Artificial Sequence
  Description of Artificial Sequence: Synthetic oligonucleotide
gggaggacgaugcggguucuuaauucuuuucaccgcagacgacucgcccga

SEQ ID NO: 12493 - RNA, 52 nt, Artificial Sequence
  Description of Artificial Sequence: Synthetic oligonucleotide
gggaggacgaugcgguuuuucauucccuuuuuuccgcagacgacucgcccga

SEQ ID NO: 12494 - RNA, 51 nt, Artificial Sequence
  Description of Artificial Sequence: Synthetic oligonucleotide
gggaggacgaugcgguuuuucuauuacuuucugcccagacgacucgcccga

SEQ ID NO: 12495 - RNA, 51 nt, Artificial Sequence
  Description of Artificial Sequence: Synthetic oligonucleotide
gggaggacgaugcgguccuuuauuucucuucgccgcagacgacucgcccga

SEQ ID NO: 12496 - RNA, 51 nt, Artificial Sequence
  Description of Artificial Sequence: Synthetic oligonucleotide
gggaggacgaugcggcacuuaucuuauucucuccgcagacgacucgcccga

SEQ ID NO: 12497 - RNA, 51 nt, Artificial Sequence
  Description of Artificial Sequence: Synthetic oligonucleotide
gggaggacgaugcgguuuccguucuucuucauccgcagacgacucgcccga

SEQ ID NO: 12498 - RNA, 51 nt, Artificial Sequence
  Description of Artificial Sequence: Synthetic oligonucleotide
gggaggacgaugcgguuuucucgcuucuauguccgcagacgacucgcccga

SEQ ID NO: 12499 - RNA, 50 nt, Artificial Sequence
  Description of Artificial Sequence: Synthetic oligonucleotide
gggaggacgaugcgguuuuuaugguuuguuuccgcagacgacucgcccga

SEQ ID NO: 12500 - RNA, 51 nt, Artificial Sequence
  Description of Artificial Sequence: Synthetic oligonucleotide
gggaggacgaugcggaucuuucucuucuugucccgcagacgacucgcccga

SEQ ID NO: 12501 - RNA, 51 nt, Artificial Sequence
  Description of Artificial Sequence: Synthetic oligonucleotide
gggaggacgaugcgguuuuucgcugucuuuuuccgcagacgacucgcccga

SEQ ID NO: 12502 - RNA, 51 nt, Artificial Sequence
  Description of Artificial Sequence: Synthetic oligonucleotide
gggaggacgaugcgguguuuauucuuguuuguccgcagacgacucgcccga

SEQ ID NO: 12503 - RNA, 50 nt, Artificial Sequence
  Description of Artificial Sequence: Synthetic oligonucleotide
gggaggacgaugcggucucuucuuuauucuuccgcagacgacucgcccga

SEQ ID NO: 12504 - RNA, 51 nt, Artificial Sequence
  Description of Artificial Sequence: Synthetic oligonucleotide
gggaggacgaugcggaauuucauucucuuuuugcccagacgacucgcccga

SEQ ID NO: 12505 - RNA, 51 nt, Artificial Sequence
  Description of Artificial Sequence: Synthetic oligonucleotide
gggaggacgaugcggcuuuuaucacauucuuuccgcagacgacucgcccga

SEQ ID NO: 12506 - RNA, 51 nt, Artificial Sequence
  Description of Artificial Sequence: Synthetic oligonucleotide
gggaggacgaugcgggcauuucuuuucccuuaccgcagacgacucgcccga

SEQ ID NO: 12507 - RNA, 51 nt, Artificial Sequence
  Description of Artificial Sequence: Synthetic oligonucleotide
gggaggacgaugcgguccauguuguuuuuuuuccgcagacgacucgcccga

SEQ ID NO: 12508 - RNA, 51 nt, Artificial Sequence
  Description of Artificial Sequence: Synthetic oligonucleotide
gggaggacgaugcggcauuuuucauuccuuuuccgcagacgacucgcccga

SEQ ID NO: 12509 - RNA, 51 nt, Artificial Sequence
  Description of Artificial Sequence: Synthetic oligonucleotide
gggaggacgaugcggauuuucuuugcuuuauucugcagacgacucgcccga

SEQ ID NO: 12510 - RNA, 49 nt, Artificial Sequence
  Description of Artificial Sequence: Synthetic oligonucleotide
gggaggacgaugcggcuuucguucugcccuccccagacgacucgcccga

SEQ ID NO: 12511 - RNA, 51 nt, Artificial Sequence
  Description of Artificial Sequence: Synthetic oligonucleotide
gggaggacgaugcggacuuuuuuuccucuuacccgcagacgacucgcccga

SEQ ID NO: 12512 - RNA, 51 nt, Artificial Sequence
  Description of Artificial Sequence: Synthetic oligonucleotide
gggaggacgaugcggaaccuuguuuucuuucaccgcagacgacucgcccga

SEQ ID NO: 12513 - RNA, 51 nt, Artificial Sequence
  Description of Artificial Sequence: Synthetic oligonucleotide
gggaggacgaugcggguuuuucuuuacucuuuccccagacgacucgcccga

SEQ ID NO: 12514 - RNA, 52 nt, Artificial Sequence
  Description of Artificial Sequence: Synthetic oligonucleotide
gggaggacgaugcggauuuuuuucuuuccuuugccgcagacgacucgcccga

SEQ ID NO: 12515 - RNA, 52 nt, Artificial Sequence
  Description of Artificial Sequence: Synthetic oligonucleotide
gggaggacgaugcgguuuguaauguuuuuuuuuccgcagacgacucgcccga

SEQ ID NO: 12516 - RNA, 52 nt, Artificial Sequence
  Description of Artificial Sequence: Synthetic oligonucleotide
gggaggacgaugcgguuuuuucauucccuuuuuccgcagacgacucgcccga

SEQ ID NO: 12517 - RNA, 51 nt, Artificial Sequence
  Description of Artificial Sequence: Synthetic oligonucleotide
gggaggacgaugcggcuuucuauaauuauucuccgcagacgacucgcccga

SEQ ID NO: 12518 - RNA, 51 nt, Artificial Sequence
  Description of Artificial Sequence: Synthetic oligonucleotide
gggaggacgaugcgguuuauuguuuauuuguuccacagacgacucgcccga

SEQ ID NO: 12519 - RNA, 51 nt, Artificial Sequence
  Description of Artificial Sequence: Synthetic oligonucleotide
gggaggacgaugcgguguuuuuugguuuuuuugcgcagacgacucgcccga

SEQ ID NO: 12520 - RNA, 53 nt, Artificial Sequence
  Description of Artificial Sequence: Synthetic oligonucleotide
gggaggacgaugcgguucguacuuuuuuuuuuuuccgcagacgacucgcccga

SEQ ID NO: 12521 - RNA, 51 nt, Artificial Sequence
  Description of Artificial Sequence: Synthetic oligonucleotide
gggaggacgaugcgguuuuugguuauauuucuccgcagacgacucgcccga

SEQ ID NO: 12522 - RNA, 51 nt, Artificial Sequence
  Description of Artificial Sequence: Synthetic oligonucleotide
gggaggacgaugcgguuuuauuuccauuuuugcaccagacgacucgcccga

SEQ ID NO: 12523 - RNA, 51 nt, Artificial Sequence
  Description of Artificial Sequence: Synthetic oligonucleotide
gggaggacgaugcgguucauuuuaguuuuuucccccagacgacucgcccga

SEQ ID NO: 12524 - RNA, 51 nt, Artificial Sequence
  Description of Artificial Sequence: Synthetic oligonucleotide
gggaggacgaugcggccuuacuauacuuuuuuccgcagacgacucgcccga

SEQ ID NO: 12525 - RNA, 51 nt, Artificial Sequence
  Description of Artificial Sequence: Synthetic oligonucleotide
gggaggacgaugcgguuaaggagaagggugguacgcagacgacucgcccga

SEQ ID NO: 12526 - RNA, 52 nt, Artificial Sequence
  Description of Artificial Sequence: Synthetic oligonucleotide
gggaggacgaugcgguuuuucauaccuuuuuuuccgcagacgacucgcccga

SEQ ID NO: 12527 - RNA, 52 nt, Artificial Sequence
  Description of Artificial Sequence: Synthetic oligonucleotide
gggaggacgaugcgguuuuuguugguguuuuuuccgcagacgacucgcccga

SEQ ID NO: 12528 - RNA, 51 nt, Artificial Sequence
  Description of Artificial Sequence: Synthetic oligonucleotide
gggaggacgaugcgguauuuuuuccuuguuuucugcagacgacucgcccga

SEQ ID NO: 12529 - RNA, 51 nt, Artificial Sequence
  Description of Artificial Sequence: Synthetic oligonucleotide
gggaggacgaugcgguuuuucauuuauuacuucugcagacgacucgcccga

SEQ ID NO: 12530 - RNA, 49 nt, Artificial Sequence
  Description of Artificial Sequence: Synthetic oligonucleotide
gggaggacgaugcgguccugucgucuuuguccccagacgacucgcccga

SEQ ID NO: 12531 - RNA, 52 nt, Artificial Sequence
  Description of Artificial Sequence: Synthetic oligonucleotide
gggaggacgaugcggaauuauguuuuuuugugaccgcagacgacucgcccga

SEQ ID NO: 12532 - RNA, 49 nt, Artificial Sequence
  Description of Artificial Sequence: Synthetic oligonucleotide
gggaggacgaugcgguccugucgucucuguccccagacgacucgcccga

SEQ ID NO: 12533 - RNA, 51 nt, Artificial Sequence
  Description of Artificial Sequence: Synthetic oligonucleotide
gggaggacgaugcggugcuuucucauuucuuuccgcagacgacucgcccga

SEQ ID NO: 12534 - RNA, 52 nt, Artificial Sequence
  Description of Artificial Sequence: Synthetic oligonucleotide
gggaggacgaugcggaauuauguguuuuuuugaccgcagacgacucgcccga

SEQ ID NO: 12535 - RNA, 50 nt, Artificial Sequence
  Description of Artificial Sequence: Synthetic oligonucleotide
gggaggacgaugcggcauaggaguaggguggugccagacgacucgcccga

SEQ ID NO: 12536 - RNA, 51 nt, Artificial Sequence
  Description of Artificial Sequence: Synthetic oligonucleotide
gggaggacgaugcgguuucuucuacuaucuauccgcagacgacucgcccga

SEQ ID NO: 12537 - RNA, 51 nt, Artificial Sequence
  Description of Artificial Sequence: Synthetic oligonucleotide
gggaggacgaugcggauccauuauacuuuucuccgcagacgacucgcccga

SEQ ID NO: 12538 - RNA, 51 nt, Artificial Sequence
  Description of Artificial Sequence: Synthetic oligonucleotide
gggaggacgaugcgguuugggaguagaguguuccgcagacgacucgcccga

SEQ ID NO: 12539 - RNA, 51 nt, Artificial Sequence
  Description of Artificial Sequence: Synthetic oligonucleotide
gggaggacgaugcggguuuuccuuuucccuuugcccagacgacucgcccga

SEQ ID NO: 12540 - RNA, 51 nt, Artificial Sequence
  Description of Artificial Sequence: Synthetic oligonucleotide
gggaggacgaugcggucauuuuauuuuuucuuccgcagacgacucgcccga

SEQ ID NO: 12541 - RNA, 51 nt, Artificial Sequence
  Description of Artificial Sequence: Synthetic oligonucleotide
gggaggacgaugcgguaguuuuccuuucuuuuccgcagacgacucgcccga

SEQ ID NO: 12542 - RNA, 51 nt, Artificial Sequence
  Description of Artificial Sequence: Synthetic oligonucleotide
gggaggacgaugcggagauuuguuuuuuguggccgcagacgacucgcccga

SEQ ID NO: 12543 - RNA, 51 nt, Artificial Sequence
  Description of Artificial Sequence: Synthetic oligonucleotide
gggaggacgaugcgguccuuuaauuuucuuugccgcagacgacucgcccga

SEQ ID NO: 12544 - RNA, 51 nt, Artificial Sequence
  Description of Artificial Sequence: Synthetic oligonucleotide
gggaggacgaugcggauugguguagggggguuccgcagacgacucgcccga

SEQ ID NO: 12545 - RNA, 51 nt, Artificial Sequence
  Description of Artificial Sequence: Synthetic oligonucleotide
gggaggacgaugcgguuaucuuguucuuucauccccagacgacucgcccga

SEQ ID NO: 12546 - RNA, 51 nt, Artificial Sequence
  Description of Artificial Sequence: Synthetic oligonucleotide
gggaggacgaugcgguuuuucucauuuucuuaccgcagacgacucgcccga

SEQ ID NO: 12547 - RNA, 51 nt, Artificial Sequence
  Description of Artificial Sequence: Synthetic oligonucleotide
gggaggacgaugcggauucuuuucuuuuuucgcugcagacgacucgcccga

SEQ ID NO: 12548 - RNA, 51 nt, Artificial Sequence
  Description of Artificial Sequence: Synthetic oligonucleotide
gggaggacgaugcggauuuuuucauuccuuuuccgcagacgacucgcccga

SEQ ID NO: 12549 - RNA, 52 nt, Artificial Sequence
  Description of Artificial Sequence: Synthetic oligonucleotide
gggaggacgaugcggaguuucauguuuuuuuguccccagacgacucgcccga

SEQ ID NO: 12550 - RNA, 51 nt, Artificial Sequence
  Description of Artificial Sequence: Synthetic oligonucleotide
gggaggacgaugcggacuuuucauuucauuugccgcagacgacucgcccga

SEQ ID NO: 12551 - RNA, 51 nt, Artificial Sequence
  Description of Artificial Sequence: Synthetic oligonucleotide
gggaggacgaugcggauuucaauguucuuucuccgcagacgacucgcccga

SEQ ID NO: 12552 - RNA, 50 nt, Artificial Sequence
  Description of Artificial Sequence: Synthetic oligonucleotide
gggaggacgaugcggucuuguuuuuuuuuggccccagacgacucgcccga

SEQ ID NO: 12553 - RNA, 50 nt, Artificial Sequence
  Description of Artificial Sequence: Synthetic oligonucleotide
gggaggacgaugcgguuucucuuaucuucugccgcagacgacucgcccga

SEQ ID NO: 12554 - RNA, 51 nt, Artificial Sequence
  Description of Artificial Sequence: Synthetic oligonucleotide
gggaggacgaugcgguuuuccuucuuuuccuuccgcagacgacucgcccga

SEQ ID NO: 12555 - RNA, 50 nt, Artificial Sequence
  Description of Artificial Sequence: Synthetic oligonucleotide
gggaggacgaugcgguuucacacuuuuuuugcugcagacgacucgcccga

SEQ ID NO: 12556 - RNA, 51 nt, Artificial Sequence
  Description of Artificial Sequence: Synthetic oligonucleotide
gggaggacgaugcgguuccuuaauuucuuuccccgcagacgacucgcccga

SEQ ID NO: 12557 - RNA, 51 nt, Artificial Sequence
  Description of Artificial Sequence: Synthetic oligonucleotide
gggaggacgaugcggaguuuugacucucuuuuccgcagacgacucgcccga

SEQ ID NO: 12558 - RNA, 50 nt, Artificial Sequence
  Description of Artificial Sequence: Synthetic oligonucleotide
gggaggacgaugcggcuuguguuuuuuuuuugcccagacgacucgcccga

SEQ ID NO: 12559 - RNA, 51 nt, Artificial Sequence
  Description of Artificial Sequence: Synthetic oligonucleotide
gggaggacgaugcgguuuauauguuucuuuccccgcagacgacucgcccga

SEQ ID NO: 12560 - RNA, 51 nt, Artificial Sequence
  Description of Artificial Sequence: Synthetic oligonucleotide
gggaggacgaugcggcauuuuuccuucuucuucgccagacgacucgcccga

SEQ ID NO: 12561 - RNA, 51 nt, Artificial Sequence
  Description of Artificial Sequence: Synthetic oligonucleotide
gggaggacgaugcgguuuuucuauguuuauuucugcagacgacucgcccga

SEQ ID NO: 12562 - RNA, 51 nt, Artificial Sequence
  Description of Artificial Sequence: Synthetic oligonucleotide
gggaggacgaugcggguauuuuuguucuucucccgcagacgacucgcccga

SEQ ID NO: 12563 - RNA, 51 nt, Artificial Sequence
  Description of Artificial Sequence: Synthetic oligonucleotide
gggaggacgaugcgguuuaucuuuaauuucccccgcagacgacucgcccga

SEQ ID NO: 12564 - RNA, 51 nt, Artificial Sequence
  Description of Artificial Sequence: Synthetic oligonucleotide
gggaggacgaugcggauucuuuaucucuuuuugcccagacgacucgcccga

SEQ ID NO: 12565 - RNA, 51 nt, Artificial Sequence
  Description of Artificial Sequence: Synthetic oligonucleotide
gggaggacgaugcgguuuucuuauuuucacauccccagacgacucgcccga

SEQ ID NO: 12566 - RNA, 51 nt, Artificial Sequence
  Description of Artificial Sequence: Synthetic oligonucleotide
gggaggacgaugcggucuuguauuuuuguuauccgcagacgacucgcccga

SEQ ID NO: 12567 - RNA, 51 nt, Artificial Sequence
  Description of Artificial Sequence: Synthetic oligonucleotide
gggaggacgaugcgguuuuuacuauuuuacuucugcagacgacucgcccga

SEQ ID NO: 12568 - RNA, 51 nt, Artificial Sequence
  Description of Artificial Sequence: Synthetic oligonucleotide
gggaggacgaugcgguuucuuuacuuuuaccucugcagacgacucgcccga

SEQ ID NO: 12569 - RNA, 52 nt, Artificial Sequence
  Description of Artificial Sequence: Synthetic oligonucleotide
gggaggacgaugcgguguuuuuguuuauuuuugccgcagacgacucgcccga

SEQ ID NO: 12570 - RNA, 50 nt, Artificial Sequence
  Description of Artificial Sequence: Synthetic oligonucleotide
gggaggacgaugcggucuuuuuucacuuucuccgcagacgacucgcccga

SEQ ID NO: 12571 - RNA, 51 nt, Artificial Sequence
  Description of Artificial Sequence: Synthetic oligonucleotide
gggaggacgaugcggaucacuauuuuuuuucaccgcagacgacucgcccga

SEQ ID NO: 12572 - RNA, 51 nt, Artificial Sequence
  Description of Artificial Sequence: Synthetic oligonucleotide
gggaggacgaugcggcauauuucuucuuuuuuccgcagacgacucgcccga

SEQ ID NO: 12573 - RNA, 51 nt, Artificial Sequence
  Description of Artificial Sequence: Synthetic oligonucleotide
gggaggacgaugcggcucuuucuuuucaucuuccgcagacgacucgcccga

SEQ ID NO: 12574 - RNA, 51 nt, Artificial Sequence
  Description of Artificial Sequence: Synthetic oligonucleotide
gggaggacgaugcgguuauuuuauucuucucucugcagacgacucgcccga

SEQ ID NO: 12575 - RNA, 51 nt, Artificial Sequence
  Description of Artificial Sequence: Synthetic oligonucleotide
gggaggacgaugcggaucucuuucacuuauuaccgcagacgacucgcccga

SEQ ID NO: 12576 - RNA, 52 nt, Artificial Sequence
  Description of Artificial Sequence: Synthetic oligonucleotide
gggaggacgaugcgguuuuuuuaguuauucucuccgcagacgacucgcccga

SEQ ID NO: 12577 - RNA, 52 nt, Artificial Sequence
  Description of Artificial Sequence: Synthetic oligonucleotide
gggaggacgaugcggucuuuuuuuguuuuuccgccgcagacgacucgcccga

SEQ ID NO: 12578 - RNA, 53 nt, Artificial Sequence
  Description of Artificial Sequence: Synthetic oligonucleotide
gggaggacgaugcgguuuccacgguuuuuuuuuuccgcagacgacucgcccga

SEQ ID NO: 12579 - RNA, 52 nt, Artificial Sequence
  Description of Artificial Sequence: Synthetic oligonucleotide
gggaggacgaugcgguuauuuuuuuuguuuguugugcagacgacucgcccga

SEQ ID NO: 12580 - RNA, 51 nt, Artificial Sequence
  Description of Artificial Sequence: Synthetic oligonucleotide
gggaggacgaugcgguccuugucgucuugcguucccagacgacucgcccga

SEQ ID NO: 12581 - RNA, 51 nt, Artificial Sequence
  Description of Artificial Sequence: Synthetic oligonucleotide
gggaggacgaugcggaaaggaggaguugggauccgcagacgacucgcccga

SEQ ID NO: 12582 - RNA, 50 nt, Artificial Sequence
  Description of Artificial Sequence: Synthetic oligonucleotide
gggaggacgaugcggaauuauguguuugugaccgcagacgacucgcccga

SEQ ID NO: 12583 - RNA, 51 nt, Artificial Sequence
  Description of Artificial Sequence: Synthetic oligonucleotide
gggaggacgaugcgguuugggaguagggugguccgcagacgacucgcccga

SEQ ID NO: 12584 - RNA, 51 nt, Artificial Sequence
  Description of Artificial Sequence: Synthetic oligonucleotide
gggaggacgaugcgguuucuacuaugcccuuuccgcagacgacucgcccga

SEQ ID NO: 12585 - RNA, 51 nt, Artificial Sequence
  Description of Artificial Sequence: Synthetic oligonucleotide
gggaggacgaugcggcguuauuucucuuuuugcugcagacgacucgcccga

SEQ ID NO: 12586 - RNA, 51 nt, Artificial Sequence
  Description of Artificial Sequence: Synthetic oligonucleotide
gggaggacgaugcggucacguucuccuaguccccccagacgacucgcccga

SEQ ID NO: 12587 - RNA, 51 nt, Artificial Sequence
  Description of Artificial Sequence: Synthetic oligonucleotide
gggaggacgaugcggguuuccucguuuucucuccgcagacgacucgcccga

SEQ ID NO: 12588 - RNA, 53 nt, Artificial Sequence
  Description of Artificial Sequence: Synthetic oligonucleotide
gggaggacgaugcgguacuuuccuuauuugcucuccgcagacgacucgcccga

SEQ ID NO: 12589 - RNA, 51 nt, Artificial Sequence
  Description of Artificial Sequence: Synthetic oligonucleotide
gggaggacgaugcggcguucauuuucuucuuaccgcagacgacucgcccga

SEQ ID NO: 12590 - RNA, 51 nt, Artificial Sequence
  Description of Artificial Sequence: Synthetic oligonucleotide
gggaggacgaugcggcuuuuccucuuucuucugcccagacgacucgcccga

SEQ ID NO: 12591 - RNA, 51 nt, Artificial Sequence
  Description of Artificial Sequence: Synthetic oligonucleotide
gggaggacgaugcggucuuuucguacuugcuuccgcagacgacucgcccga

SEQ ID NO: 12592 - RNA, 51 nt, Artificial Sequence
  Description of Artificial Sequence: Synthetic oligonucleotide
gggaggacgaugcggcuuucuugacccuuucuccgcagacgacucgcccga

SEQ ID NO: 12593 - RNA, 51 nt, Artificial Sequence
  Description of Artificial Sequence: Synthetic oligonucleotide
gggaggacgaugcgguuugggaguaguguguuccgcagacgacucgcccga

SEQ ID NO: 12594 - RNA, 51 nt, Artificial Sequence
  Description of Artificial Sequence: Synthetic oligonucleotide
gggaggacgaugcggaguuucauguuuuuuguccccagacgacucgcccga

SEQ ID NO: 12595 - RNA, 51 nt, Artificial Sequence
  Description of Artificial Sequence: Synthetic oligonucleotide
gggaggacgaugcggauucguuuucauuauuaccgcagacgacucgcccga

SEQ ID NO: 12596 - RNA, 51 nt, Artificial Sequence
  Description of Artificial Sequence: Synthetic oligonucleotide
gggaggacgaugcggucacuuuuccuuuauccccgcagacgacucgcccga

SEQ ID NO: 12597 - RNA, 52 nt, Artificial Sequence
  Description of Artificial Sequence: Synthetic oligonucleotide
gggaggacgaugcggauuccacuuuuuuuuucaccgcagacgacucgcccga

SEQ ID NO: 12598 - RNA, 51 nt, Artificial Sequence
  Description of Artificial Sequence: Synthetic oligonucleotide
gggaggacgaugcggcuuuuuuguauuuguuuccgcagacgacucgcccga

SEQ ID NO: 12599 - RNA, 50 nt, Artificial Sequence
  Description of Artificial Sequence: Synthetic oligonucleotide
gggaggacgaugcgguuugguuuuuuuuugcccgcagacgacucgcccga

SEQ ID NO: 12600 - RNA, 51 nt, Artificial Sequence
  Description of Artificial Sequence: Synthetic oligonucleotide
gggaggacgaugcggucuuuuuauuuuccucggcccagacgacucgcccga

SEQ ID NO: 12601 - RNA, 51 nt, Artificial Sequence
  Description of Artificial Sequence: Synthetic oligonucleotide
gggaggacgaugcgguguuuuguuuuuuugucccccagacgacucgcccga

SEQ ID NO: 12602 - RNA, 52 nt, Artificial Sequence
  Description of Artificial Sequence: Synthetic oligonucleotide
gggaggacgaugcgguuuuuuuccucgcuuuugccgcagacgacucgcccga

SEQ ID NO: 12603 - RNA, 51 nt, Artificial Sequence
  Description of Artificial Sequence: Synthetic oligonucleotide
gggaggacgaugcggguuauuuaccuuuuuuuccgcagacgacucgcccga

SEQ ID NO: 12604 - RNA, 51 nt, Artificial Sequence
  Description of Artificial Sequence: Synthetic oligonucleotide
gggaggacgaugcggcucuuuaaaauucucuuccgcagacgacucgcccga

SEQ ID NO: 12605 - RNA, 51 nt, Artificial Sequence
  Description of Artificial Sequence: Synthetic oligonucleotide
gggaggacgaugcgguauuuucuuuuucuucgcaccagacgacucgcccga

SEQ ID NO: 12606 - RNA, 51 nt, Artificial Sequence
  Description of Artificial Sequence: Synthetic oligonucleotide
gggaggacgaugcgguuuauuucuuauuguuugcgcagacgacucgcccga

SEQ ID NO: 12607 - RNA, 51 nt, Artificial Sequence
  Description of Artificial Sequence: Synthetic oligonucleotide
gggaggacgaugcggguuuuuacuuuuuuacuccccagacgacucgcccga

SEQ ID NO: 12608 - RNA, 51 nt, Artificial Sequence
  Description of Artificial Sequence: Synthetic oligonucleotide
gggaggacgaugcggcuucuauauuuucuacuccgcagacgacucgcccga

SEQ ID NO: 12609 - RNA, 51 nt, Artificial Sequence
  Description of Artificial Sequence: Synthetic oligonucleotide
gggaggacgaugcgguuucuuuacuuacucucccgcagacgacucgcccga

SEQ ID NO: 12610 - RNA, 51 nt, Artificial Sequence
  Description of Artificial Sequence: Synthetic oligonucleotide
gggaggacgaugcggguuuauguuuaccuuucguccagacgacucgcccga

SEQ ID NO: 12611 - RNA, 51 nt, Artificial Sequence
  Description of Artificial Sequence: Synthetic oligonucleotide
gggaggacgaugcggauauuuuaucucuuuucccgcagacgacucgcccga

SEQ ID NO: 12612 - RNA, 51 nt, Artificial Sequence
  Description of Artificial Sequence: Synthetic oligonucleotide
gggaggacgaugcggacacuauuuuccuuuuuccccagacgacucgcccga

SEQ ID NO: 12613 - RNA, 51 nt, Artificial Sequence
  Description of Artificial Sequence: Synthetic oligonucleotide
gggaggacgaugcggaucuucuugacucuuuaccgcagacgacucgcccga

SEQ ID NO: 12614 - RNA, 51 nt, Artificial Sequence
  Description of Artificial Sequence: Synthetic oligonucleotide
gggaggacgaugcggccuuuuuucuauccuuuccgcagacgacucgcccga

SEQ ID NO: 12615 - RNA, 51 nt, Artificial Sequence
  Description of Artificial Sequence: Synthetic oligonucleotide
gggaggacgaugcggucuucagguuuauuuuuccgcagacgacucgcccga

SEQ ID NO: 12616 - RNA, 51 nt, Artificial Sequence
  Description of Artificial Sequence: Synthetic oligonucleotide
gggaggacgaugcgguuucuauuaauccuuuucugcagacgacucgcccga

SEQ ID NO: 12617 - RNA, 50 nt, Artificial Sequence
  Description of Artificial Sequence: Synthetic oligonucleotide
gggaggacgaugcgguacuuuucuuuuuucuccgcagacgacucgcccga

SEQ ID NO: 12618 - RNA, 51 nt, Artificial Sequence
  Description of Artificial Sequence: Synthetic oligonucleotide
gggaggacgaugcggucuugucuuaauuuuucccgcagacgacucgcccga

SEQ ID NO: 12619 - RNA, 51 nt, Artificial Sequence
  Description of Artificial Sequence: Synthetic oligonucleotide
gggaggacgaugcggguuuuucuuuuuccuuaccgcagacgacucgcccga

SEQ ID NO: 12620 - RNA, 50 nt, Artificial Sequence
  Description of Artificial Sequence: Synthetic oligonucleotide
gggaggacgaugcggguuuguucuuuuuuuuccgcagacgacucgcccga

SEQ ID NO: 12621 - RNA, 51 nt, Artificial Sequence
  Description of Artificial Sequence: Synthetic oligonucleotide
gggaggacgaugcgguuuuguucuguuauuuuccccagacgacucgcccga

SEQ ID NO: 12622 - RNA, 51 nt, Artificial Sequence
  Description of Artificial Sequence: Synthetic oligonucleotide
gggaggacgaugcgguguuuuauuuauccuuucgccagacgacucgcccga

SEQ ID NO: 12623 - RNA, 51 nt, Artificial Sequence
  Description of Artificial Sequence: Synthetic oligonucleotide
gggaggacgaugcggguuguuuuaauguuuuuccccagacgacucgcccga

SEQ ID NO: 12624 - RNA, 51 nt, Artificial Sequence
  Description of Artificial Sequence: Synthetic oligonucleotide
gggaggacgaugcgggauucucuuauuucuuaccccagacgacucgcccga

SEQ ID NO: 12625 - RNA, 49 nt, Artificial Sequence
  Description of Artificial Sequence: Synthetic oligonucleotide
gggaggacgaugcgguuuuacuuuuuuuuugugcagacgacucgcccga

SEQ ID NO: 12626 - RNA, 51 nt, Artificial Sequence
  Description of Artificial Sequence: Synthetic oligonucleotide
gggaggacgaugcgguuuuauuucuucuuuguguccagacgacucgcccga

SEQ ID NO: 12627 - RNA, 53 nt, Artificial Sequence
  Description of Artificial Sequence: Synthetic oligonucleotide
gggaggacgaugcgguuuauucuguuuuuuuuuuccgcagacgacucgcccga

SEQ ID NO: 12628 - RNA, 51 nt, Artificial Sequence
  Description of Artificial Sequence: Synthetic oligonucleotide
gggaggacgaugcggcuuucuaaucuauuuuuccgcagacgacucgcccga

SEQ ID NO: 12629 - RNA, 51 nt, Artificial Sequence
  Description of Artificial Sequence: Synthetic oligonucleotide
gggaggacgaugcgguuugggguuuucccgucccccagacgacucgcccga

SEQ ID NO: 12630 - RNA, 49 nt, Artificial Sequence
  Description of Artificial Sequence: Synthetic oligonucleotide
gggaggacgaugcgguccugucguguucguccccagacgacucgcccga

SEQ ID NO: 12631 - RNA, 51 nt, Artificial Sequence
  Description of Artificial Sequence: Synthetic oligonucleotide
gggaggacgaugcgguccuugucgucuugcgcccccagacgacucgcccga

SEQ ID NO: 12632 - RNA, 51 nt, Artificial Sequence
  Description of Artificial Sequence: Synthetic oligonucleotide
gggaggacgaugcggguugguguagggagguuccgcagacgacucgcccga

SEQ ID NO: 12633 - RNA, 51 nt, Artificial Sequence
  Description of Artificial Sequence: Synthetic oligonucleotide
gggaggacgaugcggauuugucuuuuguguuaccgcagacgacucgcccga

SEQ ID NO: 12634 - RNA, 51 nt, Artificial Sequence
  Description of Artificial Sequence: Synthetic oligonucleotide
gggaggacgaugcggucuucuuuucuucugcuccgcagacgacucgcccga

SEQ ID NO: 12635 - RNA, 51 nt, Artificial Sequence
  Description of Artificial Sequence: Synthetic oligonucleotide
gggaggacgaugcggauuuguucauguuuccuccgcagacgacucgcccga

SEQ ID NO: 12636 - RNA, 51 nt, Artificial Sequence
  Description of Artificial Sequence: Synthetic oligonucleotide
gggaggacgaugcggcacuacuuuauuccucuccgcagacgacucgcccga

SEQ ID NO: 12637 - RNA, 51 nt, Artificial Sequence
  Description of Artificial Sequence: Synthetic oligonucleotide
gggaggacgaugcggguuuucaaucgcucuuuccgcagacgacucgcccga

SEQ ID NO: 12638 - RNA, 51 nt, Artificial Sequence
  Description of Artificial Sequence: Synthetic oligonucleotide
gggaggacgaugcgguacuuucucauuuucugcugcagacgacucgcccga

SEQ ID NO: 12639 - RNA, 51 nt, Artificial Sequence
  Description of Artificial Sequence: Synthetic oligonucleotide
gggaggacgaugcggauuuauuaucgcuguuuccgcagacgacucgcccga

SEQ ID NO: 12640 - RNA, 51 nt, Artificial Sequence
  Description of Artificial Sequence: Synthetic oligonucleotide
gggaggacgaugcggcuuuuuacgcccuuuuuccgcagacgacucgcccga

SEQ ID NO: 12641 - RNA, 53 nt, Artificial Sequence
  Description of Artificial Sequence: Synthetic oligonucleotide
gggaggacgaugcgguuuccuagaguuuuuuguuccgcagacgacucgcccga

SEQ ID NO: 12642 - RNA, 51 nt, Artificial Sequence
  Description of Artificial Sequence: Synthetic oligonucleotide
gggaggacgaugcggguuuuuauucucucauuccccagacgacucgcccga

SEQ ID NO: 12643 - RNA, 51 nt, Artificial Sequence
  Description of Artificial Sequence: Synthetic oligonucleotide
gggaggacgaugcgguuucauacuuccuacuuccgcagacgacucgcccga

SEQ ID NO: 12644 - RNA, 53 nt, Artificial Sequence
  Description of Artificial Sequence: Synthetic oligonucleotide
gggaggacgaugcggcuuuuccuuuuuuuuuguuccgcagacgacucgcccga

SEQ ID NO: 12645 - RNA, 51 nt, Artificial Sequence
  Description of Artificial Sequence: Synthetic oligonucleotide
gggaggacgaugcggacuuugcucuuguuuuaccccagacgacucgcccga

SEQ ID NO: 12646 - RNA, 51 nt, Artificial Sequence
  Description of Artificial Sequence: Synthetic oligonucleotide
gggaggacgaugcggucuuuauuuauugcuauccgcagacgacucgcccga

SEQ ID NO: 12647 - RNA, 51 nt, Artificial Sequence
  Description of Artificial Sequence: Synthetic oligonucleotide
gggaggacgaugcggcuuucgcuuuuuaucuuccgcagacgacucgcccga

SEQ ID NO: 12648 - RNA, 51 nt, Artificial Sequence
  Description of Artificial Sequence: Synthetic oligonucleotide
gggaggacgaugcgguuuucacauucuuuucucgccagacgacucgcccga

SEQ ID NO: 12649 - RNA, 51 nt, Artificial Sequence
  Description of Artificial Sequence: Synthetic oligonucleotide
gggaggacgaugcggaucuuaaucucuuuucuccgcagacgacucgcccga

SEQ ID NO: 12650 - RNA, 51 nt, Artificial Sequence
  Description of Artificial Sequence: Synthetic oligonucleotide
gggaggacgaugcggucuuuaauuauuccccuccgcagacgacucgcccga

SEQ ID NO: 12651 - RNA, 51 nt, Artificial Sequence
  Description of Artificial Sequence: Synthetic oligonucleotide
gggaggacgaugcggaauuccuuuuaucuuugccccagacgacucgcccga

SEQ ID NO: 12652 - RNA, 51 nt, Artificial Sequence
  Description of Artificial Sequence: Synthetic oligonucleotide
gggaggacgaugcggguuucuuauuaucuuucccccagacgacucgcccga

SEQ ID NO: 12653 - RNA, 51 nt, Artificial Sequence
  Description of Artificial Sequence: Synthetic oligonucleotide
gggaggacgaugcgguaucucuggccuuuuuuccgcagacgacucgcccga

SEQ ID NO: 12654 - RNA, 51 nt, Artificial Sequence
  Description of Artificial Sequence: Synthetic oligonucleotide
gggaggacgaugcgguuauuuuuguuuguuugccccagacgacucgcccga

SEQ ID NO: 12655 - RNA, 51 nt, Artificial Sequence
  Description of Artificial Sequence: Synthetic oligonucleotide
gggaggacgaugcggacuuuuuaucuuuccaaccgcagacgacucgcccga

SEQ ID NO: 12656 - RNA, 51 nt, Artificial Sequence
  Description of Artificial Sequence: Synthetic oligonucleotide
gggaggacgaugcggauucuuuacacuauucaccgcagacgacucgcccga

SEQ ID NO: 12657 - RNA, 51 nt, Artificial Sequence
  Description of Artificial Sequence: Synthetic oligonucleotide
gggaggacgaugcggcuuuuucaauccuucuuccgcagacgacucgcccga

SEQ ID NO: 12658 - RNA, 51 nt, Artificial Sequence
  Description of Artificial Sequence: Synthetic oligonucleotide
gggaggacgaugcggacuuuuuucacuuucuuccgcagacgacucgcccga

SEQ ID NO: 12659 - RNA, 51 nt, Artificial Sequence
  Description of Artificial Sequence: Synthetic oligonucleotide
gggaggacgaugcgggauuguuuauuuuuuacccccagacgacucgcccga

SEQ ID NO: 12660 - RNA, 51 nt, Artificial Sequence
  Description of Artificial Sequence: Synthetic oligonucleotide
gggaggacgaugcggcuucuguuuucauucuuccgcagacgacucgcccga

SEQ ID NO: 12661 - RNA, 51 nt, Artificial Sequence
  Description of Artificial Sequence: Synthetic oligonucleotide
gggaggacgaugcgguuucauuuuuuuauucuccgcagacgacucgcccga

SEQ ID NO: 12662 - RNA, 51 nt, Artificial Sequence
  Description of Artificial Sequence: Synthetic oligonucleotide
gggaggacgaugcggucauucuuuuuauuccucugcagacgacucgcccga

SEQ ID NO: 12663 - RNA, 52 nt, Artificial Sequence
  Description of Artificial Sequence: Synthetic oligonucleotide
gggaggacgaugcgguuucugacacuuuuuuuuccgcagacgacucgcccga

SEQ ID NO: 12664 - RNA, 51 nt, Artificial Sequence
  Description of Artificial Sequence: Synthetic oligonucleotide
gggaggacgaugcggacuuucuauauuucauuccgcagacgacucgcccga

SEQ ID NO: 12665 - RNA, 51 nt, Artificial Sequence
  Description of Artificial Sequence: Synthetic oligonucleotide
gggaggacgaugcggauuuauuuaugcuuuuuccccagacgacucgcccga

SEQ ID NO: 12666 - RNA, 50 nt, Artificial Sequence
  Description of Artificial Sequence: Synthetic oligonucleotide
gggaggacgaugcgguuuguuuuuuuuguuucugcagacgacucgcccga

SEQ ID NO: 12667 - RNA, 51 nt, Artificial Sequence
  Description of Artificial Sequence: Synthetic oligonucleotide
gggaggacgaugcgguauucucuuuuuccuuucugcagacgacucgcccga

SEQ ID NO: 12668 - RNA, 51 nt, Artificial Sequence
  Description of Artificial Sequence: Synthetic oligonucleotide
gggaggacgaugcggauauuuuccaucuuuugcugcagacgacucgcccga

SEQ ID NO: 12669 - RNA, 51 nt, Artificial Sequence
  Description of Artificial Sequence: Synthetic oligonucleotide
gggaggacgaugcggucuuuuauuuuauuuccccccagacgacucgcccga

SEQ ID NO: 12670 - RNA, 51 nt, Artificial Sequence
  Description of Artificial Sequence: Synthetic oligonucleotide
gggaggacgaugcggcuuuuauucuauuuuuuccgcagacgacucgcccga

SEQ ID NO: 12671 - RNA, 52 nt, Artificial Sequence
  Description of Artificial Sequence: Synthetic oligonucleotide
gggaggacgaugcgguuuuuauuuuucuuuucgccacagacgacucgcccga

SEQ ID NO: 12672 - RNA, 51 nt, Artificial Sequence
  Description of Artificial Sequence: Synthetic oligonucleotide
gggaggacgaugcggcuuuauuuuuuccucuugcccagacgacucgcccga

SEQ ID NO: 12673 - RNA, 51 nt, Artificial Sequence
  Description of Artificial Sequence: Synthetic oligonucleotide
gggaggacgaugcggcuucuuuauuucucucucgccagacgacucgcccga

SEQ ID NO: 12674 - RNA, 52 nt, Artificial Sequence
  Description of Artificial Sequence: Synthetic oligonucleotide
gggaggacgaugcggauuguuuuauuguuuuuaccgcagacgacucgcccga

SEQ ID NO: 12675 - RNA, 52 nt, Artificial Sequence
  Description of Artificial Sequence: Synthetic oligonucleotide
gggaggacgaugcggauauuauuuuguuuuuuugcccagacgacucgcccga

SEQ ID NO: 12676 - RNA, 51 nt, Artificial Sequence
  Description of Artificial Sequence: Synthetic oligonucleotide
gggaggacgaugcggauuuacuuuuuauuacugugcagacgacucgcccga

SEQ ID NO: 12677 - RNA, 50 nt, Artificial Sequence
  Description of Artificial Sequence: Synthetic oligonucleotide
gggaggacgaugcgguuuuccuuauacuuuuccgcagacgacucgcccga

SEQ ID NO: 12678 - RNA, 52 nt, Artificial Sequence
  Description of Artificial Sequence: Synthetic oligonucleotide
gggaggacgaugcggccauuucuucauuuuuuuccgcagacgacucgcccga

SEQ ID NO: 12679 - RNA, 51 nt, Artificial Sequence
  Description of Artificial Sequence: Synthetic oligonucleotide
gggaggacgaugcgguccugucggcugugcguccccagacgacucgcccga

SEQ ID NO: 12680 - RNA, 51 nt, Artificial Sequence
  Description of Artificial Sequence: Synthetic oligonucleotide
gggaggacgaugcgguccuuucguucugccuuccccagacgacucgcccga

SEQ ID NO: 12681 - RNA, 51 nt, Artificial Sequence
  Description of Artificial Sequence: Synthetic oligonucleotide
gggaggacgaugcgguucucauuucuucaccuccgcagacgacucgcccga

SEQ ID NO: 12682 - RNA, 51 nt, Artificial Sequence
  Description of Artificial Sequence: Synthetic oligonucleotide
gggaggacgaugcggaauguucuucucuuuguccgcagacgacucgcccga

SEQ ID NO: 12683 - RNA, 51 nt, Artificial Sequence
  Description of Artificial Sequence: Synthetic oligonucleotide
gggaggacgaugcgguuugggaguaggauguuccgcagacgacucgcccga

SEQ ID NO: 12684 - RNA, 51 nt, Artificial Sequence
  Description of Artificial Sequence: Synthetic oligonucleotide
gggaggacgaugcggccuuucuuuucuuucccgcccagacgacucgcccga

SEQ ID NO: 12685 - RNA, 51 nt, Artificial Sequence
  Description of Artificial Sequence: Synthetic oligonucleotide
gggaggacgaugcggucuuuguaaccuucuuuccgcagacgacucgcccga

SEQ ID NO: 12686 - RNA, 51 nt, Artificial Sequence
  Description of Artificial Sequence: Synthetic oligonucleotide
gggaggacgaugcgggaucauuuuacucuucuccccagacgacucgcccga

SEQ ID NO: 12687 - RNA, 51 nt, Artificial Sequence
  Description of Artificial Sequence: Synthetic oligonucleotide
gggaggacgaugcggacucuuucguauucuuuccgcagacgacucgcccga

SEQ ID NO: 12688 - RNA, 51 nt, Artificial Sequence
  Description of Artificial Sequence: Synthetic oligonucleotide
gggaggacgaugcggcucuuuuaugucccuuuccgcagacgacucgcccga

SEQ ID NO: 12689 - RNA, 51 nt, Artificial Sequence
  Description of Artificial Sequence: Synthetic oligonucleotide
gggaggacgaugcggucuuuugcuguuuucauccgcagacgacucgcccga

SEQ ID NO: 12690 - RNA, 52 nt, Artificial Sequence
  Description of Artificial Sequence: Synthetic oligonucleotide
gggaggacgaugcgguacucaucuuacuucuuuccgcagacgacucgcccga

SEQ ID NO: 12691 - RNA, 51 nt, Artificial Sequence
  Description of Artificial Sequence: Synthetic oligonucleotide
gggaggacgaugcgguuuccuaucuuguucuuccgcagacgacucgcccga

SEQ ID NO: 12692 - RNA, 51 nt, Artificial Sequence
  Description of Artificial Sequence: Synthetic oligonucleotide
gggaggacgaugcgguauuuuuccuuucuugugcccagacgacucgcccga

SEQ ID NO: 12693 - RNA, 51 nt, Artificial Sequence
  Description of Artificial Sequence: Synthetic oligonucleotide
gggaggacgaugcggucuguuuuuauuguuugccgcagacgacucgcccga

SEQ ID NO: 12694 - RNA, 51 nt, Artificial Sequence
  Description of Artificial Sequence: Synthetic oligonucleotide
gggaggacgaugcgguuuuucuuucaccuuuuccccagacgacucgcccga

SEQ ID NO: 12695 - RNA, 51 nt, Artificial Sequence
  Description of Artificial Sequence: Synthetic oligonucleotide
gggaggacgaugcgguuccuuacuuuucccuuccgcagacgacucgcccga

SEQ ID NO: 12696 - RNA, 51 nt, Artificial Sequence
  Description of Artificial Sequence: Synthetic oligonucleotide
gggaggacgaugcgggcuuuuuucuuuucccgccgcagacgacucgcccga

SEQ ID NO: 12697 - RNA, 51 nt, Artificial Sequence
  Description of Artificial Sequence: Synthetic oligonucleotide
gggaggacgaugcggucuuguuuggucuuucuccgcagacgacucgcccga

SEQ ID NO: 12698 - RNA, 51 nt, Artificial Sequence
  Description of Artificial Sequence: Synthetic oligonucleotide
gggaggacgaugcgguauuuucuuauuuucgacugcagacgacucgcccga

SEQ ID NO: 12699 - RNA, 51 nt, Artificial Sequence
  Description of Artificial Sequence: Synthetic oligonucleotide
gggaggacgaugcgguuauuucuuuguuuucgccccagacgacucgcccga

SEQ ID NO: 12700 - RNA, 51 nt, Artificial Sequence
  Description of Artificial Sequence: Synthetic oligonucleotide
gggaggacgaugcggauucucuuucuuuuucuccgcagacgacucgcccga

SEQ ID NO: 12701 - RNA, 53 nt, Artificial Sequence
  Description of Artificial Sequence: Synthetic oligonucleotide
gggaggacgaugcgguuuucguuuuuuuuuugcgccgcagacgacucgcccga

SEQ ID NO: 12702 - RNA, 51 nt, Artificial Sequence
  Description of Artificial Sequence: Synthetic oligonucleotide
gggaggacgaugcggccuucauucauucucuuccgcagacgacucgcccga

SEQ ID NO: 12703 - RNA, 52 nt, Artificial Sequence
  Description of Artificial Sequence: Synthetic oligonucleotide
gggaggacgaugcggauaguuuuguuuuuuucgccgcagacgacucgcccga

SEQ ID NO: 12704 - RNA, 51 nt, Artificial Sequence
  Description of Artificial Sequence: Synthetic oligonucleotide
gggaggacgaugcggacuucucaucuuuuucuccgcagacgacucgcccga

SEQ ID NO: 12705 - RNA, 51 nt, Artificial Sequence
  Description of Artificial Sequence: Synthetic oligonucleotide
gggaggacgaugcgguguuuuuacucuugcuuccgcagacgacucgcccga

SEQ ID NO: 12706 - RNA, 51 nt, Artificial Sequence
  Description of Artificial Sequence: Synthetic oligonucleotide
gggaggacgaugcgguuuuuguuagcuuucccccgcagacgacucgcccga

SEQ ID NO: 12707 - RNA, 51 nt, Artificial Sequence
  Description of Artificial Sequence: Synthetic oligonucleotide
gggaggacgaugcggugcuuugguuuuuuuuuccgcagacgacucgcccga

SEQ ID NO: 12708 - RNA, 51 nt, Artificial Sequence
  Description of Artificial Sequence: Synthetic oligonucleotide
gggaggacgaugcgguuuucuuuaucuauucgccgcagacgacucgcccga

SEQ ID NO: 12709 - RNA, 51 nt, Artificial Sequence
  Description of Artificial Sequence: Synthetic oligonucleotide
gggaggacgaugcggaucuuauuucuauuuugccgcagacgacucgcccga

SEQ ID NO: 12710 - RNA, 51 nt, Artificial Sequence
  Description of Artificial Sequence: Synthetic oligonucleotide
gggaggacgaugcggcuucucguuuuuuucuaccgcagacgacucgcccga

SEQ ID NO: 12711 - RNA, 51 nt, Artificial Sequence
  Description of Artificial Sequence: Synthetic oligonucleotide
gggaggacgaugcggccuuuaacgauucuuuuccgcagacgacucgcccga

SEQ ID NO: 12712 - RNA, 51 nt, Artificial Sequence
  Description of Artificial Sequence: Synthetic oligonucleotide
gggaggacgaugcgguucuuuuuguuuucaugccgcagacgacucgcccga

SEQ ID NO: 12713 - RNA, 51 nt, Artificial Sequence
  Description of Artificial Sequence: Synthetic oligonucleotide
gggaggacgaugcggauuuucuucuucucuuaccgcagacgacucgcccga

SEQ ID NO: 12714 - RNA, 51 nt, Artificial Sequence
  Description of Artificial Sequence: Synthetic oligonucleotide
gggaggacgaugcggcuuucaugcuuccuuuaccgcagacgacucgcccga

SEQ ID NO: 12715 - RNA, 51 nt, Artificial Sequence
  Description of Artificial Sequence: Synthetic oligonucleotide
gggaggacgaugcgguuuauccuauuucucguccgcagacgacucgcccga

SEQ ID NO: 12716 - RNA, 51 nt, Artificial Sequence
  Description of Artificial Sequence: Synthetic oligonucleotide
gggaggacgaugcggcuuuauuacguuucuuuccgcagacgacucgcccga

SEQ ID NO: 12717 - RNA, 52 nt, Artificial Sequence
  Description of Artificial Sequence: Synthetic oligonucleotide
gggaggacgaugcgguuguuauucuuuuuuuugccccagacgacucgcccga

SEQ ID NO: 12718 - RNA, 51 nt, Artificial Sequence
  Description of Artificial Sequence: Synthetic oligonucleotide
gggaggacgaugcggaccuuuuuaauuuuucuccgcagacgacucgcccga

SEQ ID NO: 12719 - RNA, 51 nt, Artificial Sequence
  Description of Artificial Sequence: Synthetic oligonucleotide
gggaggacgaugcgguuugucucuuauuuuacccgcagacgacucgcccga

SEQ ID NO: 12720 - RNA, 51 nt, Artificial Sequence
  Description of Artificial Sequence: Synthetic oligonucleotide
gggaggacgaugcgguuuuuauuuucuuguuccugcagacgacucgcccga

SEQ ID NO: 12721 - RNA, 51 nt, Artificial Sequence
  Description of Artificial Sequence: Synthetic oligonucleotide
gggaggacgaugcggguuuuuuaauuuuuguuccccagacgacucgcccga

SEQ ID NO: 12722 - RNA, 51 nt, Artificial Sequence
  Description of Artificial Sequence: Synthetic oligonucleotide
gggaggacgaugcggucauuugguuuuuuuauccgcagacgacucgcccga

SEQ ID NO: 12723 - RNA, 53 nt, Artificial Sequence
  Description of Artificial Sequence: Synthetic oligonucleotide
gggaggacgaugcgguuccacuuuuuuuuuuucuccgcagacgacucgcccga

SEQ ID NO: 12724 - RNA, 51 nt, Artificial Sequence
  Description of Artificial Sequence: Synthetic oligonucleotide
gggaggacgaugcgguuacuuuucuuuuucuaccccagacgacucgcccga

SEQ ID NO: 12725 - RNA, 51 nt, Artificial Sequence
  Description of Artificial Sequence: Synthetic oligonucleotide
gggaggacgaugcggcuuuuuaucuaucuuuaccgcagacgacucgcccga

SEQ ID NO: 12726 - RNA, 52 nt, Artificial Sequence
  Description of Artificial Sequence: Synthetic oligonucleotide
gggaggacgaugcggaacacuuuuuuauucuuacugcagacgacucgcccga

SEQ ID NO: 12727 - RNA, 51 nt, Artificial Sequence
  Description of Artificial Sequence: Synthetic oligonucleotide
gggaggacgaugcggucgcuuuauuuacuuuuccccagacgacucgcccga

SEQ ID NO: 12728 - RNA, 51 nt, Artificial Sequence
  Description of Artificial Sequence: Synthetic oligonucleotide
gggaggacgaugcggucuuuuacuaauuuaccccgcagacgacucgcccga

SEQ ID NO: 12729 - RNA, 52 nt, Artificial Sequence
  Description of Artificial Sequence: Synthetic oligonucleotide
gggaggacgaugcgguguuuuauuuguuuuuuuccccagacgacucgcccga

SEQ ID NO: 12730 - RNA, 49 nt, Artificial Sequence
  Description of Artificial Sequence: Synthetic oligonucleotide
gggaggacgaugcgguuuguuuuucucuuuccgcagacgacucgcccga

SEQ ID NO: 12731 - RNA, 53 nt, Artificial Sequence
  Description of Artificial Sequence: Synthetic oligonucleotide
gggaggacgaugcgguuuguuuuauuuuuuuuguccccagacgacucgcccga

SEQ ID NO: 12732 - RNA, 50 nt, Artificial Sequence
  Description of Artificial Sequence: Synthetic oligonucleotide
gggaggacgaugcgguauuuacguuuuuuuugugcagacgacucgcccga

SEQ ID NO: 12733 - RNA, 49 nt, Artificial Sequence
  Description of Artificial Sequence: Synthetic oligonucleotide
gggaggacgaugcgguuucuucuuucuuuuccgcagacgacucgcccga

SEQ ID NO: 12734 - RNA, 52 nt, Artificial Sequence
  Description of Artificial Sequence: Synthetic oligonucleotide
gggaggacgaugcgguuuuaucucuguuuuuuugcccagacgacucgcccga

SEQ ID NO: 12735 - RNA, 52 nt, Artificial Sequence
  Description of Artificial Sequence: Synthetic oligonucleotide
gggaggacgaugcgguccugucgucuguucgugccccagacgacucgcccga

SEQ ID NO: 12736 - RNA, 49 nt, Artificial Sequence
  Description of Artificial Sequence: Synthetic oligonucleotide
gggaggacgaugcggaucuuuucuuucuugccgcagacgacucgcccga

SEQ ID NO: 12737 - RNA, 52 nt, Artificial Sequence
  Description of Artificial Sequence: Synthetic oligonucleotide
gggaggacgaugcggauucggucuuuuuuugcuccgcagacgacucgcccga

SEQ ID NO: 12738 - RNA, 51 nt, Artificial Sequence
  Description of Artificial Sequence: Synthetic oligonucleotide
gggaggacgaugcgguuuuuaguuuucuuguuccgcagacgacucgcccga

SEQ ID NO: 12739 - RNA, 51 nt, Artificial Sequence
  Description of Artificial Sequence: Synthetic oligonucleotide
gggaggacgaugcggauucacuuuauuccccaccgcagacgacucgcccga

SEQ ID NO: 12740 - RNA, 50 nt, Artificial Sequence
  Description of Artificial Sequence: Synthetic oligonucleotide
gggaggacgaugcggcuuuuccuuuuuuguuccgcagacgacucgcccga

SEQ ID NO: 12741 - RNA, 51 nt, Artificial Sequence
  Description of Artificial Sequence: Synthetic oligonucleotide
gggaggacgaugcggguuuuguucuuguguuuccgcagacgacucgcccga

SEQ ID NO: 12742 - RNA, 51 nt, Artificial Sequence
  Description of Artificial Sequence: Synthetic oligonucleotide
gggaggacgaugcggaucuuuucuuuccuuugccgcagacgacucgcccga

SEQ ID NO: 12743 - RNA, 51 nt, Artificial Sequence
  Description of Artificial Sequence: Synthetic oligonucleotide
gggaggacgaugcggucacauuuuucucucguccccagacgacucgcccga

SEQ ID NO: 12744 - RNA, 51 nt, Artificial Sequence
  Description of Artificial Sequence: Synthetic oligonucleotide
gggaggacgaugcgguacuuacuuuaucuucuccgcagacgacucgcccga

SEQ ID NO: 12745 - RNA, 51 nt, Artificial Sequence
  Description of Artificial Sequence: Synthetic oligonucleotide
gggaggacgaugcggaauccuuuuccuucuauccgcagacgacucgcccga

SEQ ID NO: 12746 - RNA, 50 nt, Artificial Sequence
  Description of Artificial Sequence: Synthetic oligonucleotide
gggaggacgaugcgguuuuuugauucuuguuccgcagacgacucgcccga

SEQ ID NO: 12747 - RNA, 51 nt, Artificial Sequence
  Description of Artificial Sequence: Synthetic oligonucleotide
gggaggacgaugcggucuuaucacguucuuuuccgcagacgacucgcccga

SEQ ID NO: 12748 - RNA, 51 nt, Artificial Sequence
  Description of Artificial Sequence: Synthetic oligonucleotide
gggaggacgaugcggcuuucacaacucucucuccgcagacgacucgcccga

SEQ ID NO: 12749 - RNA, 52 nt, Artificial Sequence
  Description of Artificial Sequence: Synthetic oligonucleotide
gggaggacgaugcggucuuuuuuucauuucucaccgcagacgacucgcccga

SEQ ID NO: 12750 - RNA, 51 nt, Artificial Sequence
  Description of Artificial Sequence: Synthetic oligonucleotide
gggaggacgaugcggugcucuuguuuuccuuuccgcagacgacucgcccga

SEQ ID NO: 12751 - RNA, 51 nt, Artificial Sequence
  Description of Artificial Sequence: Synthetic oligonucleotide
gggaggacgaugcggguucuacuauuucuucaccgcagacgacucgcccga

SEQ ID NO: 12752 - RNA, 51 nt, Artificial Sequence
  Description of Artificial Sequence: Synthetic oligonucleotide
gggaggacgaugcggacucucuuucuuuucugccgcagacgacucgcccga

SEQ ID NO: 12753 - RNA, 51 nt, Artificial Sequence
  Description of Artificial Sequence: Synthetic oligonucleotide
gggaggacgaugcggccuuuuuaacuaccuuuccgcagacgacucgcccga

SEQ ID NO: 12754 - RNA, 51 nt, Artificial Sequence
  Description of Artificial Sequence: Synthetic oligonucleotide
gggaggacgaugcgguccaugcuuuuuuuuugccgcagacgacucgcccga

SEQ ID NO: 12755 - RNA, 51 nt, Artificial Sequence
  Description of Artificial Sequence: Synthetic oligonucleotide
gggaggacgaugcggccuuucuuuuucccuauccgcagacgacucgcccga

SEQ ID NO: 12756 - RNA, 51 nt, Artificial Sequence
  Description of Artificial Sequence: Synthetic oligonucleotide
gggaggacgaugcggguucauguuucuuuccaccgcagacgacucgcccga

SEQ ID NO: 12757 - RNA, 51 nt, Artificial Sequence
  Description of Artificial Sequence: Synthetic oligonucleotide
gggaggacgaugcggauuucccucuuucauuaccgcagacgacucgcccga

SEQ ID NO: 12758 - RNA, 50 nt, Artificial Sequence
  Description of Artificial Sequence: Synthetic oligonucleotide
gggaggacgaugcggauuucucuucuucuugccgcagacgacucgcccga

SEQ ID NO: 12759 - RNA, 51 nt, Artificial Sequence
  Description of Artificial Sequence: Synthetic oligonucleotide
gggaggacgaugcggaauuucucucgcucuauccgcagacgacucgcccga

SEQ ID NO: 12760 - RNA, 51 nt, Artificial Sequence
  Description of Artificial Sequence: Synthetic oligonucleotide
gggaggacgaugcggucuuuuuguucuuucuugcccagacgacucgcccga

SEQ ID NO: 12761 - RNA, 51 nt, Artificial Sequence
  Description of Artificial Sequence: Synthetic oligonucleotide
gggaggacgaugcgguuuuuuccuuaauuuguccgcagacgacucgcccga

SEQ ID NO: 12762 - RNA, 51 nt, Artificial Sequence
  Description of Artificial Sequence: Synthetic oligonucleotide
gggaggacgaugcggauuuuuaaguuguuuuugcccagacgacucgcccga

SEQ ID NO: 12763 - RNA, 51 nt, Artificial Sequence
  Description of Artificial Sequence: Synthetic oligonucleotide
gggaggacgaugcgguucuuuuugucauucuucugcagacgacucgcccga

SEQ ID NO: 12764 - RNA, 51 nt, Artificial Sequence
  Description of Artificial Sequence: Synthetic oligonucleotide
gggaggacgaugcggauacuuuaccuuuuuuugcccagacgacucgcccga

SEQ ID NO: 12765 - RNA, 51 nt, Artificial Sequence
  Description of Artificial Sequence: Synthetic oligonucleotide
gggaggacgaugcggccauuucuuuucuuacuccgcagacgacucgcccga

SEQ ID NO: 12766 - RNA, 51 nt, Artificial Sequence
  Description of Artificial Sequence: Synthetic oligonucleotide
gggaggacgaugcgguucucuauuaucuuuguccgcagacgacucgcccga

SEQ ID NO: 12767 - RNA, 52 nt, Artificial Sequence
  Description of Artificial Sequence: Synthetic oligonucleotide
gggaggacgaugcggacuuuauucucuuuuuuuccgcagacgacucgcccga

SEQ ID NO: 12768 - RNA, 52 nt, Artificial Sequence
  Description of Artificial Sequence: Synthetic oligonucleotide
gggaggacgaugcggauuuuuuuguuguuuugaccgcagacgacucgcccga

SEQ ID NO: 12769 - RNA, 51 nt, Artificial Sequence
  Description of Artificial Sequence: Synthetic oligonucleotide
gggaggacgaugcgguuuucuuuuguuuuuuugugcagacgacucgcccga

SEQ ID NO: 12770 - RNA, 51 nt, Artificial Sequence
  Description of Artificial Sequence: Synthetic oligonucleotide
gggaggacgaugcgguuauucuuuuguuuuuacgccagacgacucgcccga

SEQ ID NO: 12771 - RNA, 51 nt, Artificial Sequence
  Description of Artificial Sequence: Synthetic oligonucleotide
gggaggacgaugcgguuacuugguuauuuuuucugcagacgacucgcccga

SEQ ID NO: 12772 - RNA, 51 nt, Artificial Sequence
  Description of Artificial Sequence: Synthetic oligonucleotide
gggaggacgaugcgguuuuugcuuuaucugucccgcagacgacucgcccga

SEQ ID NO: 12773 - RNA, 51 nt, Artificial Sequence
  Description of Artificial Sequence: Synthetic oligonucleotide
gggaggacgaugcgguucauuuucuauucuuugcccagacgacucgcccga

SEQ ID NO: 12774 - RNA, 51 nt, Artificial Sequence
  Description of Artificial Sequence: Synthetic oligonucleotide
gggaggacgaugcgguucuuuuucuucuauucccgcagacgacucgcccga

SEQ ID NO: 12775 - RNA, 51 nt, Artificial Sequence
  Description of Artificial Sequence: Synthetic oligonucleotide
gggaggacgaugcggcuuucucuuauucuuccccgcagacgacucgcccga

SEQ ID NO: 12776 - RNA, 51 nt, Artificial Sequence
  Description of Artificial Sequence: Synthetic oligonucleotide
gggaggacgaugcgguuuuuacugcuuuuuauccgcagacgacucgcccga

SEQ ID NO: 12777 - RNA, 51 nt, Artificial Sequence
  Description of Artificial Sequence: Synthetic oligonucleotide
gggaggacgaugcggucacuuucauauuucuuccgcagacgacucgcccga

SEQ ID NO: 12778 - RNA, 50 nt, Artificial Sequence
  Description of Artificial Sequence: Synthetic oligonucleotide
gggaggacgaugcgguuuuuuuuucuuguuuccgcagacgacucgcccga

SEQ ID NO: 12779 - RNA, 51 nt, Artificial Sequence
  Description of Artificial Sequence: Synthetic oligonucleotide
gggaggacgaugcggucuuucagcucuuuuucccgcagacgacucgcccga

SEQ ID NO: 12780 - RNA, 53 nt, Artificial Sequence
  Description of Artificial Sequence: Synthetic oligonucleotide
gggaggacgaugcggccuuguuuguuuuuuuuucccgcagacgacucgcccga

SEQ ID NO: 12781 - RNA, 51 nt, Artificial Sequence
  Description of Artificial Sequence: Synthetic oligonucleotide
gggaggacgaugcgguuucugcuauuuuucuuccgcagacgacucgcccga

SEQ ID NO: 12782 - RNA, 51 nt, Artificial Sequence
  Description of Artificial Sequence: Synthetic oligonucleotide
gggaggacgaugcggaauuuauuauuucuccgccgcagacgacucgcccga

SEQ ID NO: 12783 - RNA, 51 nt, Artificial Sequence
  Description of Artificial Sequence: Synthetic oligonucleotide
gggaggacgaugcgguuguuauuuauuuguuugcccagacgacucgcccga

SEQ ID NO: 12784 - RNA, 51 nt, Artificial Sequence
  Description of Artificial Sequence: Synthetic oligonucleotide
gggaggacgaugcggcuuuuuuaauuacccuuccgcagacgacucgcccga

SEQ ID NO: 12785 - RNA, 51 nt, Artificial Sequence
  Description of Artificial Sequence: Synthetic oligonucleotide
gggaggacgaugcggcuuauuuaucuuguuuucugcagacgacucgcccga

SEQ ID NO: 12786 - RNA, 51 nt, Artificial Sequence
  Description of Artificial Sequence: Synthetic oligonucleotide
gggaggacgaugcggcacuuucauuuucuuuucgccagacgacucgcccga

SEQ ID NO: 12787 - RNA, 51 nt, Artificial Sequence
  Description of Artificial Sequence: Synthetic oligonucleotide
gggaggacgaugcggcccuuauuuauucgcuuccgcagacgacucgcccga

SEQ ID NO: 12788 - RNA, 52 nt, Artificial Sequence
  Description of Artificial Sequence: Synthetic oligonucleotide
gggaggacgaugcggucuuuauuuuuuuccuuuccgcagacgacucgcccga

SEQ ID NO: 12789 - RNA, 51 nt, Artificial Sequence
  Description of Artificial Sequence: Synthetic oligonucleotide
gggaggacgaugcgguauuucacaucucuuuuccgcagacgacucgcccga

SEQ ID NO: 12790 - RNA, 51 nt, Artificial Sequence
  Description of Artificial Sequence: Synthetic oligonucleotide
gggaggacgaugcggucuuuuacuuucuuauccugcagacgacucgcccga

SEQ ID NO: 12791 - RNA, 51 nt, Artificial Sequence
  Description of Artificial Sequence: Synthetic oligonucleotide
gggaggacgaugcgguuuauuuuacguuuguucugcagacgacucgcccga

SEQ ID NO: 12792 - RNA, 51 nt, Artificial Sequence
  Description of Artificial Sequence: Synthetic oligonucleotide
gggaggacgaugcggcuuuuuuuccuuuuuuuccgcagacgacucgcccga

SEQ ID NO: 12793 - RNA, 51 nt, Artificial Sequence
  Description of Artificial Sequence: Synthetic oligonucleotide
gggaggacgaugcgguccguuucuuucuuuccccgcagacgacucgcccga

SEQ ID NO: 12794 - RNA, 51 nt, Artificial Sequence
  Description of Artificial Sequence: Synthetic oligonucleotide
gggaggacgaugcgguuuuuuaccaaccuuuuccgcagacgacucgcccga

SEQ ID NO: 12795 - RNA, 52 nt, Artificial Sequence
  Description of Artificial Sequence: Synthetic oligonucleotide
gggaggacgaugcgguuuauuuuuuuuuucgcuccgcagacgacucgcccga

SEQ ID NO: 12796 - RNA, 52 nt, Artificial Sequence
  Description of Artificial Sequence: Synthetic oligonucleotide
gggaggacgaugcgguuucauuuuuuuuauucuccgcagacgacucgcccga

SEQ ID NO: 12797 - RNA, 52 nt, Artificial Sequence
  Description of Artificial Sequence: Synthetic oligonucleotide
gggaggacgaugcgguacuuuaaucuuuuuuuuccgcagacgacucgcccga

SEQ ID NO: 12798 - RNA, 51 nt, Artificial Sequence
  Description of Artificial Sequence: Synthetic oligonucleotide
gggaggacgaugcggacauuuucucuuuuucugcgcagacgacucgcccga

SEQ ID NO: 12799 - RNA, 53 nt, Artificial Sequence
  Description of Artificial Sequence: Synthetic oligonucleotide
gggaggacgaugcgguauuuauuuuuuucuugccccgcagacgacucgcccga

SEQ ID NO: 12800 - RNA, 52 nt, Artificial Sequence
  Description of Artificial Sequence: Synthetic oligonucleotide
gggaggacgaugcggauuuuuugucuuuuguuacugcagacgacucgcccga

SEQ ID NO: 12801 - RNA, 50 nt, Artificial Sequence
  Description of Artificial Sequence: Synthetic oligonucleotide
gggaggacgaugcgguuuuucauaccuuuuuccgcagacgacucgcccga

SEQ ID NO: 12802 - RNA, 51 nt, Artificial Sequence
  Description of Artificial Sequence: Synthetic oligonucleotide
gggaggacgaugcgguuuguuguuguuuuuuucugcagacgacucgcccga

SEQ ID NO: 12803 - RNA, 52 nt, Artificial Sequence
  Description of Artificial Sequence: Synthetic oligonucleotide
gggaggacgaugcggcuuuucauuucuuuuuuuccgcagacgacucgcccga

SEQ ID NO: 12804 - RNA, 49 nt, Artificial Sequence
  Description of Artificial Sequence: Synthetic oligonucleotide
gggaggacgaugcggucuuguuuuuuuuggccccagacgacucgcccga

SEQ ID NO: 12805 - RNA, 52 nt, Artificial Sequence
  Description of Artificial Sequence: Synthetic oligonucleotide
gggaggacgaugcggugugucuuuucuuuucugccccagacgacucgcccga

SEQ ID NO: 12806 - RNA, 51 nt, Artificial Sequence
  Description of Artificial Sequence: Synthetic oligonucleotide
gggaggacgaugcggucccuucguucugcccuccccagacgacucgcccga

SEQ ID NO: 12807 - RNA, 51 nt, Artificial Sequence
  Description of Artificial Sequence: Synthetic oligonucleotide
gggaggacgaugcggucuuauuuucuuuugucccccagacgacucgcccga

SEQ ID NO: 12808 - RNA, 52 nt, Artificial Sequence
  Description of Artificial Sequence: Synthetic oligonucleotide
gggaggacgaugcggcaccuuuucuuuuccgcuccgcagacgacucgcccga

SEQ ID NO: 12809 - RNA, 51 nt, Artificial Sequence
  Description of Artificial Sequence: Synthetic oligonucleotide
gggaggacgaugcggauuccuuuucuucuuugccgcagacgacucgcccga

SEQ ID NO: 12810 - RNA, 51 nt, Artificial Sequence
  Description of Artificial Sequence: Synthetic oligonucleotide
gggaggacgaugcgguucuucguauucucuugccgcagacgacucgcccga

SEQ ID NO: 12811 - RNA, 51 nt, Artificial Sequence
  Description of Artificial Sequence: Synthetic oligonucleotide
gggaggacgaugcgguuuucguuuuuuuugcgccgcagacgacucgcccga

SEQ ID NO: 12812 - RNA, 51 nt, Artificial Sequence
  Description of Artificial Sequence: Synthetic oligonucleotide
gggaggacgaugcgguaucugucucuuuuucgccgcagacgacucgcccga

SEQ ID NO: 12813 - RNA, 52 nt, Artificial Sequence
  Description of Artificial Sequence: Synthetic oligonucleotide
gggaggacgaugcggccuguuuauuuuuuugccccccagacgacucgcccga

SEQ ID NO: 12814 - RNA, 52 nt, Artificial Sequence
  Description of Artificial Sequence: Synthetic oligonucleotide
gggaggacgaugcggagauuuguuuuuuuguggccgcagacgacucgcccga

SEQ ID NO: 12815 - RNA, 51 nt, Artificial Sequence
  Description of Artificial Sequence: Synthetic oligonucleotide
gggaggacgaugcgguucuuuuggcuuauucuccgcagacgacucgcccga

SEQ ID NO: 12816 - RNA, 50 nt, Artificial Sequence
  Description of Artificial Sequence: Synthetic oligonucleotide
gggaggacgaugcggaucuuuucuucuucugccgcagacgacucgcccga

SEQ ID NO: 12817 - RNA, 51 nt, Artificial Sequence
  Description of Artificial Sequence: Synthetic oligonucleotide
gggaggacgaugcggguugcuuuuuucuauucccccagacgacucgcccga

SEQ ID NO: 12818 - RNA, 51 nt, Artificial Sequence
  Description of Artificial Sequence: Synthetic oligonucleotide
gggaggacgaugcgguuuuacucauuuuucccgugcagacgacucgcccga

SEQ ID NO: 12819 - RNA, 52 nt, Artificial Sequence
  Description of Artificial Sequence: Synthetic oligonucleotide
gggaggacgaugcgguguuuuguuuuuuuugucccccagacgacucgcccga

SEQ ID NO: 12820 - RNA, 51 nt, Artificial Sequence
  Description of Artificial Sequence: Synthetic oligonucleotide
gggaggacgaugcggaugcucucuuuuucuugccgcagacgacucgcccga

SEQ ID NO: 12821 - RNA, 51 nt, Artificial Sequence
  Description of Artificial Sequence: Synthetic oligonucleotide
gggaggacgaugcgguuuucuuugucuucuugccgcagacgacucgcccga

SEQ ID NO: 12822 - RNA, 51 nt, Artificial Sequence
  Description of Artificial Sequence: Synthetic oligonucleotide
gggaggacgaugcggaccuuauuuuaucuucuccgcagacgacucgcccga

SEQ ID NO: 12823 - RNA, 51 nt, Artificial Sequence
  Description of Artificial Sequence: Synthetic oligonucleotide
gggaggacgaugcggauuaucuaauucuuucaccgcagacgacucgcccga

SEQ ID NO: 12824 - RNA, 51 nt, Artificial Sequence
  Description of Artificial Sequence: Synthetic oligonucleotide
gggaggacgaugcggcuuugcuuauuuuuucuccgcagacgacucgcccga

SEQ ID NO: 12825 - RNA, 51 nt, Artificial Sequence
  Description of Artificial Sequence: Synthetic oligonucleotide
gggaggacgaugcgguuauuauccuuuuucucccgcagacgacucgcccga

SEQ ID NO: 12826 - RNA, 51 nt, Artificial Sequence
  Description of Artificial Sequence: Synthetic oligonucleotide
gggaggacgaugcggaauuuuccccucuuuuaccgcagacgacucgcccga

SEQ ID NO: 12827 - RNA, 51 nt, Artificial Sequence
  Description of Artificial Sequence: Synthetic oligonucleotide
gggaggacgaugcggucuucaugguuauuuuuccgcagacgacucgcccga

SEQ ID NO: 12828 - RNA, 50 nt, Artificial Sequence
  Description of Artificial Sequence: Synthetic oligonucleotide
gggaggacgaugcggucuuuucucuaucuauccgcagacgacucgcccga

SEQ ID NO: 12829 - RNA, 51 nt, Artificial Sequence
  Description of Artificial Sequence: Synthetic oligonucleotide
gggaggacgaugcggauguuucucuucucuuuccgcagacgacucgcccga

SEQ ID NO: 12830 - RNA, 51 nt, Artificial Sequence
  Description of Artificial Sequence: Synthetic oligonucleotide
gggaggacgaugcggcuauuccuauucccuuuccgcagacgacucgcccga

SEQ ID NO: 12831 - RNA, 51 nt, Artificial Sequence
  Description of Artificial Sequence: Synthetic oligonucleotide
gggaggacgaugcgguuuucuuauuucucuacccgcagacgacucgcccga

SEQ ID NO: 12832 - RNA, 50 nt, Artificial Sequence
  Description of Artificial Sequence: Synthetic oligonucleotide
gggaggacgaugcggauuggaggaggagguuccgcagacgacucgcccga

SEQ ID NO: 12833 - RNA, 51 nt, Artificial Sequence
  Description of Artificial Sequence: Synthetic oligonucleotide
gggaggacgaugcggucuuucacuagcuuuuuccgcagacgacucgcccga

SEQ ID NO: 12834 - RNA, 50 nt, Artificial Sequence
  Description of Artificial Sequence: Synthetic oligonucleotide
gggaggacgaugcggauuucuucuucuuuuaccgcagacgacucgcccga

SEQ ID NO: 12835 - RNA, 50 nt, Artificial Sequence
  Description of Artificial Sequence: Synthetic oligonucleotide
gggaggacgaugcggcuuuuucuucuuucuccgccagacgacucgcccga

SEQ ID NO: 12836 - RNA, 51 nt, Artificial Sequence
  Description of Artificial Sequence: Synthetic oligonucleotide
gggaggacgaugcgguuucuuuuguauuuuauccccagacgacucgcccga

SEQ ID NO: 12837 - RNA, 51 nt, Artificial Sequence
  Description of Artificial Sequence: Synthetic oligonucleotide
gggaggacgaugcgguuucuuuguuuuccugccgccagacgacucgcccga

SEQ ID NO: 12838 - RNA, 49 nt, Artificial Sequence
  Description of Artificial Sequence: Synthetic oligonucleotide
gggaggacgaugcgggccuucguucugccuccccagacgacucgcccga

SEQ ID NO: 12839 - RNA, 51 nt, Artificial Sequence
  Description of Artificial Sequence: Synthetic oligonucleotide
gggaggacgaugcgguucuuuuuauucuacauccgcagacgacucgcccga

SEQ ID NO: 12840 - RNA, 51 nt, Artificial Sequence
  Description of Artificial Sequence: Synthetic oligonucleotide
gggaggacgaugcgguuuucugguuuuuacuuccgcagacgacucgcccga

SEQ ID NO: 12841 - RNA, 51 nt, Artificial Sequence
  Description of Artificial Sequence: Synthetic oligonucleotide
gggaggacgaugcggauuuucucauuucucuaccccagacgacucgcccga

SEQ ID NO: 12842 - RNA, 51 nt, Artificial Sequence
  Description of Artificial Sequence: Synthetic oligonucleotide
gggaggacgaugcgguuuucucuauguuuuauccccagacgacucgcccga

SEQ ID NO: 12843 - RNA, 51 nt, Artificial Sequence
  Description of Artificial Sequence: Synthetic oligonucleotide
gggaggacgaugcgguauucuuucuuucuuuucgccagacgacucgcccga

SEQ ID NO: 12844 - RNA, 51 nt, Artificial Sequence
  Description of Artificial Sequence: Synthetic oligonucleotide
gggaggacgaugcggccuguuuuucucguuuuccgcagacgacucgcccga

SEQ ID NO: 12845 - RNA, 51 nt, Artificial Sequence
  Description of Artificial Sequence: Synthetic oligonucleotide
gggaggacgaugcgguuuggcucucuuauuuuccgcagacgacucgcccga

SEQ ID NO: 12846 - RNA, 51 nt, Artificial Sequence
  Description of Artificial Sequence: Synthetic oligonucleotide
gggaggacgaugcggguuuacuuuaacuuuuuccccagacgacucgcccga

SEQ ID NO: 12847 - RNA, 52 nt, Artificial Sequence
  Description of Artificial Sequence: Synthetic oligonucleotide
gggaggacgaugcgguuuuuuaauguuuuuuuuccgcagacgacucgcccga

SEQ ID NO: 12848 - RNA, 51 nt, Artificial Sequence
  Description of Artificial Sequence: Synthetic oligonucleotide
gggaggacgaugcggguauuuauuucuuguugcugcagacgacucgcccga

SEQ ID NO: 12849 - RNA, 52 nt, Artificial Sequence
  Description of Artificial Sequence: Synthetic oligonucleotide
gggaggacgaugcgguuuucuaucuuuuuuuguccgcagacgacucgcccga

SEQ ID NO: 12850 - RNA, 52 nt, Artificial Sequence
  Description of Artificial Sequence: Synthetic oligonucleotide
gggaggacgaugcgguuuuuucuuuuccuuuguccgcagacgacucgcccga

SEQ ID NO: 12851 - RNA, 52 nt, Artificial Sequence
  Description of Artificial Sequence: Synthetic oligonucleotide
gggaggacgaugcgguuuguuuuucucuuuuuuccgcagacgacucgcccga

SEQ ID NO: 12852 - RNA, 53 nt, Artificial Sequence
  Description of Artificial Sequence: Synthetic oligonucleotide
gggaggacgaugcgguuuuagcuucuuuuuuuguccucagacgacucgcccga

SEQ ID NO: 12853 - RNA, 51 nt, Artificial Sequence
  Description of Artificial Sequence: Synthetic oligonucleotide
gggaggacgaugcggauuccuauuuucuucucccgcagacgacucgcccga

SEQ ID NO: 12854 - RNA, 51 nt, Artificial Sequence
  Description of Artificial Sequence: Synthetic oligonucleotide
gggaggacgaugcggcuuuucucguacuauuuccgcagacgacucgcccga

SEQ ID NO: 12855 - RNA, 52 nt, Artificial Sequence
  Description of Artificial Sequence: Synthetic oligonucleotide
gggaggacgaugcgguuuuacauucauuuuuugcgccagacgacucgcccga

SEQ ID NO: 12856 - RNA, 51 nt, Artificial Sequence
  Description of Artificial Sequence: Synthetic oligonucleotide
gggaggacgaugcgguuuuauuuauucucucuccgcagacgacucgcccga

SEQ ID NO: 12857 - RNA, 51 nt, Artificial Sequence
  Description of Artificial Sequence: Synthetic oligonucleotide
gggaggacgaugcggcuuuauaucuauuuucuccgcagacgacucgcccga

SEQ ID NO: 12858 - RNA, 51 nt, Artificial Sequence
  Description of Artificial Sequence: Synthetic oligonucleotide
gggaggacgaugcgguuuuuucuuguugcuugcugcagacgacucgcccga

SEQ ID NO: 12859 - RNA, 51 nt, Artificial Sequence
  Description of Artificial Sequence: Synthetic oligonucleotide
gggaggacgaugcggguucuuauuuucuuccccugcagacgacucgcccga

SEQ ID NO: 12860 - RNA, 51 nt, Artificial Sequence
  Description of Artificial Sequence: Synthetic oligonucleotide
gggaggacgaugcgguuauuucuauucuuucucugcagacgacucgcccga

SEQ ID NO: 12861 - RNA, 51 nt, Artificial Sequence
  Description of Artificial Sequence: Synthetic oligonucleotide
gggaggacgaugcgguuuuuguuauccuuuuacgccagacgacucgcccga

SEQ ID NO: 12862 - RNA, 51 nt, Artificial Sequence
  Description of Artificial Sequence: Synthetic oligonucleotide
gggaggacgaugcggucuucuuuuuucacuuuccgcagacgacucgcccga

SEQ ID NO: 12863 - RNA, 52 nt, Artificial Sequence
  Description of Artificial Sequence: Synthetic oligonucleotide
gggaggacgaugcgguuuugcuuuuuuuuuuucccccagacgacucgcccga

SEQ ID NO: 12864 - RNA, 52 nt, Artificial Sequence
  Description of Artificial Sequence: Synthetic oligonucleotide
gggaggacgaugcggucuuuuuuuccuauuucuccgcagacgacucgcccga

SEQ ID NO: 12865 - RNA, 51 nt, Artificial Sequence
  Description of Artificial Sequence: Synthetic oligonucleotide
gggaggacgaugcgguuucucuuuuucucacccgccagacgacucgcccga

SEQ ID NO: 12866 - RNA, 51 nt, Artificial Sequence
  Description of Artificial Sequence: Synthetic oligonucleotide
gggaggacgaugcgguuauuucuuuguucuuugcgcagacgacucgcccga

SEQ ID NO: 12867 - RNA, 51 nt, Artificial Sequence
  Description of Artificial Sequence: Synthetic oligonucleotide
gggaggacgaugcgguuguucuuguuuuuauucugcagacgacucgcccga

SEQ ID NO: 12868 - RNA, 51 nt, Artificial Sequence
  Description of Artificial Sequence: Synthetic oligonucleotide
gggaggacgaugcggaguuacuuuuuacuuuucugcagacgacucgcccga

SEQ ID NO: 12869 - RNA, 51 nt, Artificial Sequence
  Description of Artificial Sequence: Synthetic oligonucleotide
gggaggacgaugcgguuuuuauauuugugguucugcagacgacucgcccga

SEQ ID NO: 12870 - RNA, 51 nt, Artificial Sequence
  Description of Artificial Sequence: Synthetic oligonucleotide
gggaggacgaugcggucacuuuuacuuuuucugcgcagacgacucgcccga

SEQ ID NO: 12871 - RNA, 51 nt, Artificial Sequence
  Description of Artificial Sequence: Synthetic oligonucleotide
gggaggacgaugcgguuuaucaaguuuuuuuuccgcagacgacucgcccga

SEQ ID NO: 12872 - RNA, 50 nt, Artificial Sequence
  Description of Artificial Sequence: Synthetic oligonucleotide
gggaggacgaugcgguuuguuuuucucuuuuccgcagacgacucgcccga

SEQ ID NO: 12873 - RNA, 50 nt, Artificial Sequence
  Description of Artificial Sequence: Synthetic oligonucleotide
gggaggacgaugcgguuuuacuuuuuuuuuugugcagacgacucgcccga

SEQ ID NO: 12874 - RNA, 52 nt, Artificial Sequence
  Description of Artificial Sequence: Synthetic oligonucleotide
gggaggacgaugcggcuuguuuccuuuuuuucuccgcagacgacucgcccga

SEQ ID NO: 12875 - RNA, 52 nt, Artificial Sequence
  Description of Artificial Sequence: Synthetic oligonucleotide
gggaggacgaugcggucuuauuuuuucucuucuccgcagacgacucgcccga

SEQ ID NO: 12876 - RNA, 53 nt, Artificial Sequence
  Description of Artificial Sequence: Synthetic oligonucleotide
gggaggacgaugcgguuucacacuuuuuuuuuugcugcagacgacucgcccga

SEQ ID NO: 12877 - RNA, 52 nt, Artificial Sequence
  Description of Artificial Sequence: Synthetic oligonucleotide
gggaggacgaugcgguccugucgucugucucguccccagacgacucgcccga

SEQ ID NO: 12878 - RNA, 52 nt, Artificial Sequence
  Description of Artificial Sequence: Synthetic oligonucleotide
gggaggacgaugcgguccugucguccuguucguccccagacgacucgcccga

SEQ ID NO: 12879 - RNA, 53 nt, Artificial Sequence
  Description of Artificial Sequence: Synthetic oligonucleotide
gggaggacgaugcggaauuauguguuuuuuguuaccgcagacgacucgcccga

SEQ ID NO: 12880 - RNA, 51 nt, Artificial Sequence
  Description of Artificial Sequence: Synthetic oligonucleotide
gggaggacgaugcgguccuuucguucugccccccccagacgacucgcccga

SEQ ID NO: 12881 - RNA, 51 nt, Artificial Sequence
  Description of Artificial Sequence: Synthetic oligonucleotide
gggaggacgaugcgguuugggaguaggguguaccgcagacgacucgcccga

SEQ ID NO: 12882 - RNA, 52 nt, Artificial Sequence
  Description of Artificial Sequence: Synthetic oligonucleotide
gggaggacgaugcggguuuuguuuuuccucgugccgcagacgacucgcccga

SEQ ID NO: 12883 - RNA, 51 nt, Artificial Sequence
  Description of Artificial Sequence: Synthetic oligonucleotide
gggaggacgaugcgguuucuuacucacuuucgccgcagacgacucgcccga

SEQ ID NO: 12884 - RNA, 53 nt, Artificial Sequence
  Description of Artificial Sequence: Synthetic oligonucleotide
gggaggacgaugcggaauuauguguuuuuuuguaccgcagacgacucgcccga

SEQ ID NO: 12885 - RNA, 51 nt, Artificial Sequence
  Description of Artificial Sequence: Synthetic oligonucleotide
gggaggacgaugcggucuuguuucuucuuucuccgcagacgacucgcccga

SEQ ID NO: 12886 - RNA, 51 nt, Artificial Sequence
  Description of Artificial Sequence: Synthetic oligonucleotide
gggaggacgaugcgguuuuacgauccuuuuugccgcagacgacucgcccga

SEQ ID NO: 12887 - RNA, 51 nt, Artificial Sequence
  Description of Artificial Sequence: Synthetic oligonucleotide
gggaggacgaugcggauguuuuucucucuugaccgcagacgacucgcccga

SEQ ID NO: 12888 - RNA, 51 nt, Artificial Sequence
  Description of Artificial Sequence: Synthetic oligonucleotide
gggaggacgaugcgguucauuccauucuuacuccgcagacgacucgcccga

SEQ ID NO: 12889 - RNA, 51 nt, Artificial Sequence
  Description of Artificial Sequence: Synthetic oligonucleotide
gggaggacgaugcgguguauuuucccucuuuuccgcagacgacucgcccga

SEQ ID NO: 12890 - RNA, 50 nt, Artificial Sequence
  Description of Artificial Sequence: Synthetic oligonucleotide
gggaggacgaugcggauuucuuuuccuuuuaccgcagacgacucgcccga

SEQ ID NO: 12891 - RNA, 51 nt, Artificial Sequence
  Description of Artificial Sequence: Synthetic oligonucleotide
gggaggacgaugcgguuggguguaggguguucccgcagacgacucgcccga

SEQ ID NO: 12892 - RNA, 51 nt, Artificial Sequence
  Description of Artificial Sequence: Synthetic oligonucleotide
gggaggacgaugcggcuuuuuuuauuuuggcuccgcagacgacucgcccga

SEQ ID NO: 12893 - RNA, 51 nt, Artificial Sequence
  Description of Artificial Sequence: Synthetic oligonucleotide
gggaggacgaugcggcuuucacguuucuucuuccgcagacgacucgcccga

SEQ ID NO: 12894 - RNA, 51 nt, Artificial Sequence
  Description of Artificial Sequence: Synthetic oligonucleotide
gggaggacgaugcgguacuucuuguuucaucuccgcagacgacucgcccga

SEQ ID NO: 12895 - RNA, 51 nt, Artificial Sequence
  Description of Artificial Sequence: Synthetic oligonucleotide
gggaggacgaugcggcuuuucuuuacucauuaccgcagacgacucgcccga

SEQ ID NO: 12896 - RNA, 51 nt, Artificial Sequence
  Description of Artificial Sequence: Synthetic oligonucleotide
gggaggacgaugcggauuuuacuaauuccuuaccgcagacgacucgcccga

SEQ ID NO: 12897 - RNA, 51 nt, Artificial Sequence
  Description of Artificial Sequence: Synthetic oligonucleotide
gggaggacgaugcgguucuauuaaauuucacuccgcagacgacucgcccga

SEQ ID NO: 12898 - RNA, 51 nt, Artificial Sequence
  Description of Artificial Sequence: Synthetic oligonucleotide
gggaggacgaugcgguuuccggguuuuuuuugccgcagacgacucgcccga

SEQ ID NO: 12899 - RNA, 51 nt, Artificial Sequence
  Description of Artificial Sequence: Synthetic oligonucleotide
gggaggacgaugcggauuuuucucuuuacuugccgcagacgacucgcccga

SEQ ID NO: 12900 - RNA, 52 nt, Artificial Sequence
  Description of Artificial Sequence: Synthetic oligonucleotide
gggaggacgaugcgguacuuuuuuuuuuccacuccgcagacgacucgcccga

SEQ ID NO: 12901 - RNA, 51 nt, Artificial Sequence
  Description of Artificial Sequence: Synthetic oligonucleotide
gggaggacgaugcgguuugaagggugcuggguccccagacgacucgcccga

SEQ ID NO: 12902 - RNA, 51 nt, Artificial Sequence
  Description of Artificial Sequence: Synthetic oligonucleotide
gggaggacgaugcggcuuuuuacauucuugcuccgcagacgacucgcccga

SEQ ID NO: 12903 - RNA, 51 nt, Artificial Sequence
  Description of Artificial Sequence: Synthetic oligonucleotide
gggaggacgaugcggcucuuucuuuuuuugcuccccagacgacucgcccga

SEQ ID NO: 12904 - RNA, 51 nt, Artificial Sequence
  Description of Artificial Sequence: Synthetic oligonucleotide
gggaggacgaugcgguuuuauuuuucccuaucccgcagacgacucgcccga

SEQ ID NO: 12905 - RNA, 51 nt, Artificial Sequence
  Description of Artificial Sequence: Synthetic oligonucleotide
gggaggacgaugcggcuuuauacugcaagccguaccagacgacucgcccga

SEQ ID NO: 12906 - RNA, 51 nt, Artificial Sequence
  Description of Artificial Sequence: Synthetic oligonucleotide
gggaggacgaugcggguaugcuuucucuuuuuccgcagacgacucgcccga

SEQ ID NO: 12907 - RNA, 51 nt, Artificial Sequence
  Description of Artificial Sequence: Synthetic oligonucleotide
gggaggacgaugcgguuuccuuuugcuuacuucugcagacgacucgcccga

SEQ ID NO: 12908 - RNA, 51 nt, Artificial Sequence
  Description of Artificial Sequence: Synthetic oligonucleotide
gggaggacgaugcgguucauauuuucacuuucccgcagacgacucgcccga

SEQ ID NO: 12909 - RNA, 51 nt, Artificial Sequence
  Description of Artificial Sequence: Synthetic oligonucleotide
gggaggacgaugcggcuauauggaggagguggagccagacgacucgcccga

SEQ ID NO: 12910 - RNA, 51 nt, Artificial Sequence
  Description of Artificial Sequence: Synthetic oligonucleotide
gggaggacgaugcgggcuuucucacuuuuuucccccagacgacucgcccga

SEQ ID NO: 12911 - RNA, 50 nt, Artificial Sequence
  Description of Artificial Sequence: Synthetic oligonucleotide
gggaggacgaugcgguccugcgucuguucguccccagacgacucgcccga

SEQ ID NO: 12912 - RNA, 51 nt, Artificial Sequence
  Description of Artificial Sequence: Synthetic oligonucleotide
gggaggacgaugcggcuuuuuguaucuucuuuccgcagacgacucgcccga

SEQ ID NO: 12913 - RNA, 52 nt, Artificial Sequence
  Description of Artificial Sequence: Synthetic oligonucleotide
gggaggacgaugcggugagucacauuuuuuuacccccagacgacucgcccga

SEQ ID NO: 12914 - RNA, 51 nt, Artificial Sequence
  Description of Artificial Sequence: Synthetic oligonucleotide
gggaggacgaugcggacacuuuuuccucuuuuccccagacgacucgcccga

SEQ ID NO: 12915 - RNA, 51 nt, Artificial Sequence
  Description of Artificial Sequence: Synthetic oligonucleotide
gggaggacgaugcgguuucccuuuacuuuuuuccgcagacgacucgcccga

SEQ ID NO: 12916 - RNA, 51 nt, Artificial Sequence
  Description of Artificial Sequence: Synthetic oligonucleotide
gggaggacgaugcggucuauuuucuucuacuuccgcagacgacucgcccga

SEQ ID NO: 12917 - RNA, 51 nt, Artificial Sequence
  Description of Artificial Sequence: Synthetic oligonucleotide
gggaggacgaugcggcuuuauuauuauucacuccgcagacgacucgcccga

SEQ ID NO: 12918 - RNA, 51 nt, Artificial Sequence
  Description of Artificial Sequence: Synthetic oligonucleotide
gggaggacgaugcgguucuuaucauucccuuuccgcagacgacucgcccga

SEQ ID NO: 12919 - RNA, 52 nt, Artificial Sequence
  Description of Artificial Sequence: Synthetic oligonucleotide
gggaggacgaugcggauuuauuuuuuuugcgccccgcagacgacucgcccga

SEQ ID NO: 12920 - RNA, 51 nt, Artificial Sequence
  Description of Artificial Sequence: Synthetic oligonucleotide
gggaggacgaugcgguucuuugucuuuuguuugcccagacgacucgcccga

SEQ ID NO: 12921 - RNA, 51 nt, Artificial Sequence
  Description of Artificial Sequence: Synthetic oligonucleotide
gggaggacgaugcgguuuuuauuuguacuuuucgccagacgacucgcccga

SEQ ID NO: 12922 - RNA, 51 nt, Artificial Sequence
  Description of Artificial Sequence: Synthetic oligonucleotide
gggaggacgaugcggauuauuuccauuccuuaccgcagacgacucgcccga

SEQ ID NO: 12923 - RNA, 52 nt, Artificial Sequence
  Description of Artificial Sequence: Synthetic oligonucleotide
gggaggacgaugcgguuauugcuuuuuuuugguccgcagacgacucgcccga

SEQ ID NO: 12924 - RNA, 51 nt, Artificial Sequence
  Description of Artificial Sequence: Synthetic oligonucleotide
gggaggacgaugcgguguuuuucguauuuuuuccgcagacgacucgcccga

SEQ ID NO: 12925 - RNA, 50 nt, Artificial Sequence
  Description of Artificial Sequence: Synthetic oligonucleotide
gggaggacgaugcggcuuuauuauucuuuuaccgcagacgacucgcccga

SEQ ID NO: 12926 - RNA, 51 nt, Artificial Sequence
  Description of Artificial Sequence: Synthetic oligonucleotide
gggaggacgaugcgguuauuuguuuauuuucucgccagacgacucgcccga

SEQ ID NO: 12927 - RNA, 52 nt, Artificial Sequence
  Description of Artificial Sequence: Synthetic oligonucleotide
gggaggacgaugcggaucuacacuuuuuuuuucccgcagacgacucgcccga

SEQ ID NO: 12928 - RNA, 51 nt, Artificial Sequence
  Description of Artificial Sequence: Synthetic oligonucleotide
gggaggacgaugcgguuugcuuuuuuuuuuauccgcagacgacucgcccga

SEQ ID NO: 12929 - RNA, 51 nt, Artificial Sequence
  Description of Artificial Sequence: Synthetic oligonucleotide
gggaggacgaugcgguuuucucgcuucacuuuccgcagacgacucgcccga

SEQ ID NO: 12930 - RNA, 51 nt, Artificial Sequence
  Description of Artificial Sequence: Synthetic oligonucleotide
gggaggacgaugcggcauaggaguagggagguuugcagacgacucgcccga

SEQ ID NO: 12931 - RNA, 51 nt, Artificial Sequence
  Description of Artificial Sequence: Synthetic oligonucleotide
gggaggacgaugcggauuuauuuucuuggcugccgcagacgacucgcccga

SEQ ID NO: 12932 - RNA, 51 nt, Artificial Sequence
  Description of Artificial Sequence: Synthetic oligonucleotide
gggaggacgaugcggucucucuacuucuuuugccgcagacgacucgcccga

SEQ ID NO: 12933 - RNA, 51 nt, Artificial Sequence
  Description of Artificial Sequence: Synthetic oligonucleotide
gggaggacgaugcggguucuaauacucucuuuccgcagacgacucgcccga

SEQ ID NO: 12934 - RNA, 51 nt, Artificial Sequence
  Description of Artificial Sequence: Synthetic oligonucleotide
gggaggacgaugcgguucguguuuucuuuuugcugcagacgacucgcccga

SEQ ID NO: 12935 - RNA, 51 nt, Artificial Sequence
  Description of Artificial Sequence: Synthetic oligonucleotide
gggaggacgaugcggucuuuaugcuuuugucuccgcagacgacucgcccga

SEQ ID NO: 12936 - RNA, 51 nt, Artificial Sequence
  Description of Artificial Sequence: Synthetic oligonucleotide
gggaggacgaugcggauuucugauuauuuuuaccgcagacgacucgcccga

SEQ ID NO: 12937 - RNA, 51 nt, Artificial Sequence
  Description of Artificial Sequence: Synthetic oligonucleotide
gggaggacgaugcgguuuauuuuugcuguuuuccgcagacgacucgcccga

SEQ ID NO: 12938 - RNA, 51 nt, Artificial Sequence
  Description of Artificial Sequence: Synthetic oligonucleotide
gggaggacgaugcggaauuuacaucuuuuuugccgcagacgacucgcccga

SEQ ID NO: 12939 - RNA, 51 nt, Artificial Sequence
  Description of Artificial Sequence: Synthetic oligonucleotide
gggaggacgaugcggccuuuuauuucuuuuuuccccagacgacucgcccga

SEQ ID NO: 12940 - RNA, 51 nt, Artificial Sequence
  Description of Artificial Sequence: Synthetic oligonucleotide
gggaggacgaugcgguuuuguuuucuuucacgcgccagacgacucgcccga

SEQ ID NO: 12941 - RNA, 51 nt, Artificial Sequence
  Description of Artificial Sequence: Synthetic oligonucleotide
gggaggacgaugcgguucuuauuuccuuuuccgcccagacgacucgcccga

SEQ ID NO: 12942 - RNA, 51 nt, Artificial Sequence
  Description of Artificial Sequence: Synthetic oligonucleotide
gggaggacgaugcggucuuugcuuuucguuuuccgcagacgacucgcccga

SEQ ID NO: 12943 - RNA, 51 nt, Artificial Sequence
  Description of Artificial Sequence: Synthetic oligonucleotide
gggaggacgaugcgguuuuuguaugauuuucuccgcagacgacucgcccga

SEQ ID NO: 12944 - RNA, 51 nt, Artificial Sequence
  Description of Artificial Sequence: Synthetic oligonucleotide
gggaggacgaugcgguucauucuguuuuucuccugcagacgacucgcccga

SEQ ID NO: 12945 - RNA, 51 nt, Artificial Sequence
  Description of Artificial Sequence: Synthetic oligonucleotide
gggaggacgaugcggucucuuuauuuuccuacccgcagacgacucgcccga

SEQ ID NO: 12946 - RNA, 53 nt, Artificial Sequence
  Description of Artificial Sequence: Synthetic oligonucleotide
gggaggacgaugcggccuuuuacuuuuuuuuucuccgcagacgacucgcccga

SEQ ID NO: 12947 - RNA, 50 nt, Artificial Sequence
  Description of Artificial Sequence: Synthetic oligonucleotide
gggaggacgaugcgguuucuugucuauuuuuccgcagacgacucgcccga

SEQ ID NO: 12948 - RNA, 51 nt, Artificial Sequence
  Description of Artificial Sequence: Synthetic oligonucleotide
gggaggacgaugcgguuucaccuuauuccuuucugcagacgacucgcccga

SEQ ID NO: 12949 - RNA, 51 nt, Artificial Sequence
  Description of Artificial Sequence: Synthetic oligonucleotide
gggaggacgaugcggcuuuuaucuucuauccuccgcagacgacucgcccga

SEQ ID NO: 12950 - RNA, 51 nt, Artificial Sequence
  Description of Artificial Sequence: Synthetic oligonucleotide
gggaggacgaugcggccuuaucuauuuucuuaccgcagacgacucgcccga

SEQ ID NO: 12951 - RNA, 52 nt, Artificial Sequence
  Description of Artificial Sequence: Synthetic oligonucleotide
gggaggacgaugcgguucuugcuuuauuuuuuuccgcagacgacucgcccga

SEQ ID NO: 12952 - RNA, 51 nt, Artificial Sequence
  Description of Artificial Sequence: Synthetic oligonucleotide
gggaggacgaugcggauucuuuuuucuuauucccgcagacgacucgcccga

SEQ ID NO: 12953 - RNA, 51 nt, Artificial Sequence
  Description of Artificial Sequence: Synthetic oligonucleotide
gggaggacgaugcggauuucacuuuuuuccuucgccagacgacucgcccga

SEQ ID NO: 12954 - RNA, 52 nt, Artificial Sequence
  Description of Artificial Sequence: Synthetic oligonucleotide
gggaggacgaugcggacuuucauauuuuuuucaccgcagacgacucgcccga

SEQ ID NO: 12955 - RNA, 51 nt, Artificial Sequence
  Description of Artificial Sequence: Synthetic oligonucleotide
gggaggacgaugcggcacauuucucauuuuauccgcagacgacucgcccga

SEQ ID NO: 12956 - RNA, 51 nt, Artificial Sequence
  Description of Artificial Sequence: Synthetic oligonucleotide
gggaggacgaugcggcuuuuucaaauuuuucuccgcagacgacucgcccga

SEQ ID NO: 12957 - RNA, 51 nt, Artificial Sequence
  Description of Artificial Sequence: Synthetic oligonucleotide
gggaggacgaugcggucauuuuuauuucuuuucgccagacgacucgcccga

SEQ ID NO: 12958 - RNA, 50 nt, Artificial Sequence
  Description of Artificial Sequence: Synthetic oligonucleotide
gggaggacgaugcgguguuuucuucuguuuugcgcagacgacucgcccga

SEQ ID NO: 12959 - RNA, 51 nt, Artificial Sequence
  Description of Artificial Sequence: Synthetic oligonucleotide
gggaggacgaugcgguuuuauuuauuuccgucccgcagacgacucgcccga

SEQ ID NO: 12960 - RNA, 51 nt, Artificial Sequence
  Description of Artificial Sequence: Synthetic oligonucleotide
gggaggacgaugcggcaucuuucuuuauuacuccgcagacgacucgcccga

SEQ ID NO: 12961 - RNA, 53 nt, Artificial Sequence
  Description of Artificial Sequence: Synthetic oligonucleotide
gggaggacgaugcgggauacuuuuuuuuuuuugcccccagacgacucgcccga

SEQ ID NO: 12962 - RNA, 52 nt, Artificial Sequence
  Description of Artificial Sequence: Synthetic oligonucleotide
gggaggacgaugcgguuaguguuuaguuuuuuugugcagacgacucgcccga

SEQ ID NO: 12963 - RNA, 51 nt, Artificial Sequence
  Description of Artificial Sequence: Synthetic oligonucleotide
gggaggacgaugcggaccuuuuguuucuauuuccgcagacgacucgcccga

SEQ ID NO: 12964 - RNA, 51 nt, Artificial Sequence
  Description of Artificial Sequence: Synthetic oligonucleotide
gggaggacgaugcggcauucucuaauuuuucuccgcagacgacucgcccga

SEQ ID NO: 12965 - RNA, 51 nt, Artificial Sequence
  Description of Artificial Sequence: Synthetic oligonucleotide
gggaggacgaugcggucacuuuauucuauucucugcagacgacucgcccga

SEQ ID NO: 12966 - RNA, 51 nt, Artificial Sequence
  Description of Artificial Sequence: Synthetic oligonucleotide
gggaggacgaugcgguuugggguuuucccgagccccagacgacucgcccga

SEQ ID NO: 12967 - RNA, 51 nt, Artificial Sequence
  Description of Artificial Sequence: Synthetic oligonucleotide
gggaggacgaugcgguuugagguuuucccgugccccagacgacucgcccga

SEQ ID NO: 12968 - RNA, 50 nt, Artificial Sequence
  Description of Artificial Sequence: Synthetic oligonucleotide
gggaggacgaugcggugagucguucccuuguccccagacgacucgcccga

SEQ ID NO: 12969 - RNA, 51 nt, Artificial Sequence
  Description of Artificial Sequence: Synthetic oligonucleotide
gggaggacgaugcgguccuugucguccugcguccccagacgacucgcccga

SEQ ID NO: 12970 - RNA, 51 nt, Artificial Sequence
  Description of Artificial Sequence: Synthetic oligonucleotide
gggaggacgaugcgguuuaggaguaggguguuccgcagacgacucgcccga

SEQ ID NO: 12971 - RNA, 51 nt, Artificial Sequence
  Description of Artificial Sequence: Synthetic oligonucleotide
gggaggacgaugcgguccuuucguccugcccuccccagacgacucgcccga

SEQ ID NO: 12972 - RNA, 51 nt, Artificial Sequence
  Description of Artificial Sequence: Synthetic oligonucleotide
gggaggacgaugcgguuugggaauaggguguuccgcagacgacucgcccga

SEQ ID NO: 12973 - RNA, 51 nt, Artificial Sequence
  Description of Artificial Sequence: Synthetic oligonucleotide
gggaggacgaugcggauuuccuuucucuguugccgcagacgacucgcccga

SEQ ID NO: 12974 - RNA, 51 nt, Artificial Sequence
  Description of Artificial Sequence: Synthetic oligonucleotide
gggaggacgaugcgggcuuucuuccuguuucuccgcagacgacucgcccga

SEQ ID NO: 12975 - RNA, 51 nt, Artificial Sequence
  Description of Artificial Sequence: Synthetic oligonucleotide
gggaggacgaugcggauccguuuguucuuucuccgcagacgacucgcccga

SEQ ID NO: 12976 - RNA, 50 nt, Artificial Sequence
  Description of Artificial Sequence: Synthetic oligonucleotide
gggaggacgaugcggauuuucucuuuuucugccgcagacgacucgcccga

SEQ ID NO: 12977 - RNA, 51 nt, Artificial Sequence
  Description of Artificial Sequence: Synthetic oligonucleotide
gggaggacgaugcggccacuauugucuuuucuccgcagacgacucgcccga

SEQ ID NO: 12978 - RNA, 51 nt, Artificial Sequence
  Description of Artificial Sequence: Synthetic oligonucleotide
gggaggacgaugcggccuuugcucuuuucccuccgcagacgacucgcccga

SEQ ID NO: 12979 - RNA, 50 nt, Artificial Sequence
  Description of Artificial Sequence: Synthetic oligonucleotide
gggaggacgaugcgguuuuccguuccuuuuuccgcagacgacucgcccga

SEQ ID NO: 12980 - RNA, 53 nt, Artificial Sequence
  Description of Artificial Sequence: Synthetic oligonucleotide
gggaggacgaugcggauccuuuauuuuucucacgccgcagacgacucgcccga

SEQ ID NO: 12981 - RNA, 51 nt, Artificial Sequence
  Description of Artificial Sequence: Synthetic oligonucleotide
gggaggacgaugcggacuucuccuacuuuucuccgcagacgacucgcccga

SEQ ID NO: 12982 - RNA, 51 nt, Artificial Sequence
  Description of Artificial Sequence: Synthetic oligonucleotide
gggaggacgaugcgggauuuuaacuuuccucuccccagacgacucgcccga

SEQ ID NO: 12983 - RNA, 51 nt, Artificial Sequence
  Description of Artificial Sequence: Synthetic oligonucleotide
gggaggacgaugcggcccuuuaaucuucuuuuccgcagacgacucgcccga

SEQ ID NO: 12984 - RNA, 51 nt, Artificial Sequence
  Description of Artificial Sequence: Synthetic oligonucleotide
gggaggacgaugcgguuucuacuccuuucacuccgcagacgacucgcccga

SEQ ID NO: 12985 - RNA, 50 nt, Artificial Sequence
  Description of Artificial Sequence: Synthetic oligonucleotide
gggaggacgaugcggauuuucuucuucuuuaccgcagacgacucgcccga

SEQ ID NO: 12986 - RNA, 51 nt, Artificial Sequence
  Description of Artificial Sequence: Synthetic oligonucleotide
gggaggacgaugcggcuuucucuuucaugcuuccgcagacgacucgcccga

SEQ ID NO: 12987 - RNA, 51 nt, Artificial Sequence
  Description of Artificial Sequence: Synthetic oligonucleotide
gggaggacgaugcggguugccuucacuuuuuuccgcagacgacucgcccga

SEQ ID NO: 12988 - RNA, 51 nt, Artificial Sequence
  Description of Artificial Sequence: Synthetic oligonucleotide
gggaggacgaugcggcuuauucuuuccguuuuccgcagacgacucgcccga

SEQ ID NO: 12989 - RNA, 51 nt, Artificial Sequence
  Description of Artificial Sequence: Synthetic oligonucleotide
gggaggacgaugcgguuuauuuugguaccuuuccgcagacgacucgcccga

SEQ ID NO: 12990 - RNA, 51 nt, Artificial Sequence
  Description of Artificial Sequence: Synthetic oligonucleotide
gggaggacgaugcggcuucguuauuucuucuuccgcagacgacucgcccga

SEQ ID NO: 12991 - RNA, 51 nt, Artificial Sequence
  Description of Artificial Sequence: Synthetic oligonucleotide
gggaggacgaugcgguuuccgauuucuuuuugccccagacgacucgcccga

SEQ ID NO: 12992 - RNA, 51 nt, Artificial Sequence
  Description of Artificial Sequence: Synthetic oligonucleotide
gggaggacgaugcggcaucuuauuuuucuuauccgcagacgacucgcccga

SEQ ID NO: 12993 - RNA, 51 nt, Artificial Sequence
  Description of Artificial Sequence: Synthetic oligonucleotide
gggaggacgaugcggauacucuuuuccuuuuugcccagacgacucgcccga

SEQ ID NO: 12994 - RNA, 51 nt, Artificial Sequence
  Description of Artificial Sequence: Synthetic oligonucleotide
gggaggacgaugcgguuuuucucuuuucugcugcccagacgacucgcccga

SEQ ID NO: 12995 - RNA, 51 nt, Artificial Sequence
  Description of Artificial Sequence: Synthetic oligonucleotide
gggaggacgaugcgguucuuacuuacucuucucugcagacgacucgcccga

SEQ ID NO: 12996 - RNA, 51 nt, Artificial Sequence
  Description of Artificial Sequence: Synthetic oligonucleotide
gggaggacgaugcgguguuuuugcuauuucuugcccagacgacucgcccga

SEQ ID NO: 12997 - RNA, 51 nt, Artificial Sequence
  Description of Artificial Sequence: Synthetic oligonucleotide
gggaggacgaugcggugauuuauuuguuuuugcaccagacgacucgcccga

SEQ ID NO: 12998 - RNA, 51 nt, Artificial Sequence
  Description of Artificial Sequence: Synthetic oligonucleotide
gggaggacgaugcgguucugucuucuuuuuacccgcagacgacucgcccga

SEQ ID NO: 12999 - RNA, 51 nt, Artificial Sequence
  Description of Artificial Sequence: Synthetic oligonucleotide
gggaggacgaugcggauuuacaucuuucgcucccgcagacgacucgcccga

SEQ ID NO: 13000 - RNA, 51 nt, Artificial Sequence
  Description of Artificial Sequence: Synthetic oligonucleotide
gggaggacgaugcgguauuuauccuuucuucugugcagacgacucgcccga

SEQ ID NO: 13001 - RNA, 51 nt, Artificial Sequence
  Description of Artificial Sequence: Synthetic oligonucleotide
gggaggacgaugcggcauuguuuuauuuuccccgccagacgacucgcccga

SEQ ID NO: 13002 - RNA, 51 nt, Artificial Sequence
  Description of Artificial Sequence: Synthetic oligonucleotide
gggaggacgaugcggccuuuuacuuuuuuuccccgcagacgacucgcccga

SEQ ID NO: 13003 - RNA, 53 nt, Artificial Sequence
  Description of Artificial Sequence: Synthetic oligonucleotide
gggaggacgaugcggcuuuuuucauucccuuuugccgcagacgacucgcccga

SEQ ID NO: 13004 - RNA, 51 nt, Artificial Sequence
  Description of Artificial Sequence: Synthetic oligonucleotide
gggaggacgaugcgguuuguuuuucuccuuuuccgcagacgacucgcccga

SEQ ID NO: 13005 - RNA, 51 nt, Artificial Sequence
  Description of Artificial Sequence: Synthetic oligonucleotide
gggaggacgaugcgguucaauucuuuacuuuuccccagacgacucgcccga

SEQ ID NO: 13006 - RNA, 52 nt, Artificial Sequence
  Description of Artificial Sequence: Synthetic oligonucleotide
gggaggacgaugcggucuuuuuuucuucuacccccgcagacgacucgcccga

SEQ ID NO: 13007 - RNA, 51 nt, Artificial Sequence
  Description of Artificial Sequence: Synthetic oligonucleotide
gggaggacgaugcggaacuuuuauugcuuuuaccccagacgacucgcccga

SEQ ID NO: 13008 - RNA, 52 nt, Artificial Sequence
  Description of Artificial Sequence: Synthetic oligonucleotide
gggaggacgaugcgggauacuuuuuuuuuuugcccccagacgacucgcccga

SEQ ID NO: 13009 - RNA, 51 nt, Artificial Sequence
  Description of Artificial Sequence: Synthetic oligonucleotide
gggaggacgaugcggucauacuuuuuuucgcucugcagacgacucgcccga

SEQ ID NO: 13010 - RNA, 51 nt, Artificial Sequence
  Description of Artificial Sequence: Synthetic oligonucleotide
gggaggacgaugcggccacguuuauuuuuuauccgcagacgacucgcccga

SEQ ID NO: 13011 - RNA, 51 nt, Artificial Sequence
  Description of Artificial Sequence: Synthetic oligonucleotide
gggaggacgaugcggcuuuuuauguucuuuuuccccagacgacucgcccga

SEQ ID NO: 13012 - RNA, 51 nt, Artificial Sequence
  Description of Artificial Sequence: Synthetic oligonucleotide
gggaggacgaugcggcuuuauuuucaugcuuaccgcagacgacucgcccga

SEQ ID NO: 13013 - RNA, 51 nt, Artificial Sequence
  Description of Artificial Sequence: Synthetic oligonucleotide
gggaggacgaugcggauuaacucuuuccuuuaccgcagacgacucgcccga

SEQ ID NO: 13014 - RNA, 51 nt, Artificial Sequence
  Description of Artificial Sequence: Synthetic oligonucleotide
gggaggacgaugcggguuuuuaguuuuuguuuccccagacgacucgcccga

SEQ ID NO: 13015 - RNA, 51 nt, Artificial Sequence
  Description of Artificial Sequence: Synthetic oligonucleotide
gggaggacgaugcggccuuuuucuuccuuuuacgccagacgacucgcccga

SEQ ID NO: 13016 - RNA, 51 nt, Artificial Sequence
  Description of Artificial Sequence: Synthetic oligonucleotide
gggaggacgaugcggaauuguucucuuuucauccgcagacgacucgcccga

SEQ ID NO: 13017 - RNA, 51 nt, Artificial Sequence
  Description of Artificial Sequence: Synthetic oligonucleotide
gggaggacgaugcgguuauuacuuaucuuucugugcagacgacucgcccga

SEQ ID NO: 13018 - RNA, 51 nt, Artificial Sequence
  Description of Artificial Sequence: Synthetic oligonucleotide
gggaggacgaugcggauuuucagcguuuuuucccgcagacgacucgcccga

SEQ ID NO: 13019 - RNA, 51 nt, Artificial Sequence
  Description of Artificial Sequence: Synthetic oligonucleotide
gggaggacgaugcggaaucuucucauuuucguccgcagacgacucgcccga

SEQ ID NO: 13020 - RNA, 51 nt, Artificial Sequence
  Description of Artificial Sequence: Synthetic oligonucleotide
gggaggacgaugcggauuauacuuuccuuuuaccccagacgacucgcccga

SEQ ID NO: 13021 - RNA, 51 nt, Artificial Sequence
  Description of Artificial Sequence: Synthetic oligonucleotide
gggaggacgaugcggccuuuucuauacuucauccgcagacgacucgcccga

SEQ ID NO: 13022 - RNA, 51 nt, Artificial Sequence
  Description of Artificial Sequence: Synthetic oligonucleotide
gggaggacgaugcgguuacuuauuccuuucucccgcagacgacucgcccga

SEQ ID NO: 13023 - RNA, 52 nt, Artificial Sequence
  Description of Artificial Sequence: Synthetic oligonucleotide
gggaggacgaugcgguuuuuucacgguuuuuuucugcagacgacucgcccga

SEQ ID NO: 13024 - RNA, 51 nt, Artificial Sequence
  Description of Artificial Sequence: Synthetic oligonucleotide
gggaggacgaugcgguuuguuucucucuuuuuccgcagacgacucgcccga

SEQ ID NO: 13025 - RNA, 51 nt, Artificial Sequence
  Description of Artificial Sequence: Synthetic oligonucleotide
gggaggacgaugcggcucuucuugucucuuuuccgcagacgacucgcccga

SEQ ID NO: 13026 - RNA, 51 nt, Artificial Sequence
  Description of Artificial Sequence: Synthetic oligonucleotide
gggaggacgaugcggguucuucuucuguuuuuccgcagacgacucgcccga

SEQ ID NO: 13027 - RNA, 51 nt, Artificial Sequence
  Description of Artificial Sequence: Synthetic oligonucleotide
gggaggacgaugcgguuacuuuuaugcuuuuuccgcagacgacucgcccga

SEQ ID NO: 13028 - RNA, 51 nt, Artificial Sequence
  Description of Artificial Sequence: Synthetic oligonucleotide
gggaggacgaugcgguuucuuauucuaucccucugcagacgacucgcccga

SEQ ID NO: 13029 - RNA, 51 nt, Artificial Sequence
  Description of Artificial Sequence: Synthetic oligonucleotide
gggaggacgaugcgguuuuacucucucuuuuucugcagacgacucgcccga

SEQ ID NO: 13030 - RNA, 51 nt, Artificial Sequence
  Description of Artificial Sequence: Synthetic oligonucleotide
gggaggacgaugcggauuuuuucccuuuauuaccgcagacgacucgcccga

SEQ ID NO: 13031 - RNA, 51 nt, Artificial Sequence
  Description of Artificial Sequence: Synthetic oligonucleotide
gggaggacgaugcggucuuaaaucuuuuccauccgcagacgacucgcccga

SEQ ID NO: 13032 - RNA, 51 nt, Artificial Sequence
  Description of Artificial Sequence: Synthetic oligonucleotide
gggaggacgaugcgguuuguguguucuuuuucccgcagacgacucgcccga

SEQ ID NO: 13033 - RNA, 51 nt, Artificial Sequence
  Description of Artificial Sequence: Synthetic oligonucleotide
gggaggacgaugcggccauuuaacuuuuuucucugcagacgacucgcccga

SEQ ID NO: 13034 - RNA, 51 nt, Artificial Sequence
  Description of Artificial Sequence: Synthetic oligonucleotide
gggaggacgaugcggcuuuacacuccaucuuuccgcagacgacucgcccga

SEQ ID NO: 13035 - RNA, 51 nt, Artificial Sequence
  Description of Artificial Sequence: Synthetic oligonucleotide
gggaggacgaugcggucuauuauaccuuuuccccgcagacgacucgcccga

SEQ ID NO: 13036 - RNA, 51 nt, Artificial Sequence
  Description of Artificial Sequence: Synthetic oligonucleotide
gggaggacgaugcggauuuaucucaauuucuaccgcagacgacucgcccga

SEQ ID NO: 13037 - RNA, 51 nt, Artificial Sequence
  Description of Artificial Sequence: Synthetic oligonucleotide
gggaggacgaugcggccuuacucuacucuuauccgcagacgacucgcccga

SEQ ID NO: 13038 - RNA, 51 nt, Artificial Sequence
  Description of Artificial Sequence: Synthetic oligonucleotide
gggaggacgaugcgguuuuuuuuugucuugcuccgcagacgacucgcccga

SEQ ID NO: 13039 - RNA, 51 nt, Artificial Sequence
  Description of Artificial Sequence: Synthetic oligonucleotide
gggaggacgaugcggacuuucaauuuuucucaccccagacgacucgcccga

SEQ ID NO: 13040 - RNA, 51 nt, Artificial Sequence
  Description of Artificial Sequence: Synthetic oligonucleotide
gggaggacgaugcgguuuucuuuaauuucuuuccccagacgacucgcccga

SEQ ID NO: 13041 - RNA, 51 nt, Artificial Sequence
  Description of Artificial Sequence: Synthetic oligonucleotide
gggaggacgaugcgguuuuguuuauuacuuuugugcagacgacucgcccga

SEQ ID NO: 13042 - RNA, 51 nt, Artificial Sequence
  Description of Artificial Sequence: Synthetic oligonucleotide
gggaggacgaugcggguccugucgucuugcguccccagacgacucgcccga

SEQ ID NO: 13043 - RNA, 51 nt, Artificial Sequence
  Description of Artificial Sequence: Synthetic oligonucleotide
gggaggacgaugcgguccggucggcuguucguccccagacgacucgcccga

SEQ ID NO: 13044 - RNA, 51 nt, Artificial Sequence
  Description of Artificial Sequence: Synthetic oligonucleotide
gggaggacgaugcggucccgucgucuuugcguccccagacgacucgcccga

SEQ ID NO: 13045 - RNA, 51 nt, Artificial Sequence
  Description of Artificial Sequence: Synthetic oligonucleotide
gggaggacgaugcgguccuugccgucuugcguccccagacgacucgcccga

SEQ ID NO: 13046 - RNA, 51 nt, Artificial Sequence
  Description of Artificial Sequence: Synthetic oligonucleotide
gggaggacgaugcggauucucuucuccucgcuccgcagacgacucgcccga

SEQ ID NO: 13047 - RNA, 50 nt, Artificial Sequence
  Description of Artificial Sequence: Synthetic oligonucleotide
gggaggacgaugcggauuccuuuucuuuucuccgcagacgacucgcccga

SEQ ID NO: 13048 - RNA, 49 nt, Artificial Sequence
  Description of Artificial Sequence: Synthetic oligonucleotide
gggaggacgaugcgguccugucgucuccguccccagacgacucgcccga

SEQ ID NO: 13049 - RNA, 52 nt, Artificial Sequence
  Description of Artificial Sequence: Synthetic oligonucleotide
gggaggacgaugcgguguuuccuuuuuccuucgccccagacgacucgcccga

SEQ ID NO: 13050 - RNA, 52 nt, Artificial Sequence
  Description of Artificial Sequence: Synthetic oligonucleotide
gggaggacgaugcgguccugucgucuguucgguccccagacgacucgcccga

SEQ ID NO: 13051 - RNA, 51 nt, Artificial Sequence
  Description of Artificial Sequence: Synthetic oligonucleotide
gggaggacgaugcgguuugagaguaggguguuccgcagacgacucgcccga

SEQ ID NO: 13052 - RNA, 51 nt, Artificial Sequence
  Description of Artificial Sequence: Synthetic oligonucleotide
gggaggacgaugcgggcuuuucguucuucccuccccagacgacucgcccga

SEQ ID NO: 13053 - RNA, 51 nt, Artificial Sequence
  Description of Artificial Sequence: Synthetic oligonucleotide
gggaggacgaugcggcaaauggagguguagggugccagacgacucgcccga

SEQ ID NO: 13054 - RNA, 51 nt, Artificial Sequence
  Description of Artificial Sequence: Synthetic oligonucleotide
gggaggacgaugcggguuuucuuuuacugucuccgcagacgacucgcccga

SEQ ID NO: 13055 - RNA, 50 nt, Artificial Sequence
  Description of Artificial Sequence: Synthetic oligonucleotide
gggaggacgaugcgguugugcguuuuuuuugccgcagacgacucgcccga

SEQ ID NO: 13056 - RNA, 51 nt, Artificial Sequence
  Description of Artificial Sequence: Synthetic oligonucleotide
gggaggacgaugcggucauuugucuuuauccuccgcagacgacucgcccga

SEQ ID NO: 13057 - RNA, 50 nt, Artificial Sequence
  Description of Artificial Sequence: Synthetic oligonucleotide
gggaggacgaugcggauuuucucuuuuuuugccgcagacgacucgcccga

SEQ ID NO: 13058 - RNA, 51 nt, Artificial Sequence
  Description of Artificial Sequence: Synthetic oligonucleotide
gggaggacgaugcgguuuuggaguaggguguuccgcagacgacucgcccga

SEQ ID NO: 13059 - RNA, 51 nt, Artificial Sequence
  Description of Artificial Sequence: Synthetic oligonucleotide
gggaggacgaugcgguuuuuguuaucucucugcgccagacgacucgcccga

SEQ ID NO: 13060 - RNA, 52 nt, Artificial Sequence
  Description of Artificial Sequence: Synthetic oligonucleotide
gggaggacgaugcgggauuucgcucauuuuuuugcccagacgacucgcccga

SEQ ID NO: 13061 - RNA, 51 nt, Artificial Sequence
  Description of Artificial Sequence: Synthetic oligonucleotide
gggaggacgaugcgguuuucucgcuuucuccgccgcagacgacucgcccga

SEQ ID NO: 13062 - RNA, 53 nt, Artificial Sequence
  Description of Artificial Sequence: Synthetic oligonucleotide
gggaggacgaugcgguccaugcuuuuuuuuuuugccgcagacgacucgcccga

SEQ ID NO: 13063 - RNA, 51 nt, Artificial Sequence
  Description of Artificial Sequence: Synthetic oligonucleotide
gggaggacgaugcgguuacuuuuuucuuccugccgcagacgacucgcccga

SEQ ID NO: 13064 - RNA, 51 nt, Artificial Sequence
  Description of Artificial Sequence: Synthetic oligonucleotide
gggaggacgaugcggcucuucauaccauuucuccgcagacgacucgcccga

SEQ ID NO: 13065 - RNA, 51 nt, Artificial Sequence
  Description of Artificial Sequence: Synthetic oligonucleotide
gggaggacgaugcggcuuguguuuuuuuuuuugcccagacgacucgcccga

SEQ ID NO: 13066 - RNA, 51 nt, Artificial Sequence
  Description of Artificial Sequence: Synthetic oligonucleotide
gggaggacgaugcgguuucacuuugacuuuuugcccagacgacucgcccga

SEQ ID NO: 13067 - RNA, 51 nt, Artificial Sequence
  Description of Artificial Sequence: Synthetic oligonucleotide
gggaggacgaugcggguucguguuucuucuuuccgcagacgacucgcccga

SEQ ID NO: 13068 - RNA, 51 nt, Artificial Sequence
  Description of Artificial Sequence: Synthetic oligonucleotide
gggaggacgaugcgguuuuuuuauugauugcuccgcagacgacucgcccga

SEQ ID NO: 13069 - RNA, 51 nt, Artificial Sequence
  Description of Artificial Sequence: Synthetic oligonucleotide
gggaggacgaugcggauauugucucuuuuuuuccgcagacgacucgcccga

SEQ ID NO: 13070 - RNA, 51 nt, Artificial Sequence
  Description of Artificial Sequence: Synthetic oligonucleotide
gggaggacgaugcggguuuuguuuguuguuucccgcagacgacucgcccga

SEQ ID NO: 13071 - RNA, 50 nt, Artificial Sequence
  Description of Artificial Sequence: Synthetic oligonucleotide
gggaggacgaugcgguugggguuuucccgugccgcagacgacucgcccga

SEQ ID NO: 13072 - RNA, 51 nt, Artificial Sequence
  Description of Artificial Sequence: Synthetic oligonucleotide
gggaggacgaugcggucuuucacucuuauuauccgcagacgacucgcccga

SEQ ID NO: 13073 - RNA, 51 nt, Artificial Sequence
  Description of Artificial Sequence: Synthetic oligonucleotide
gggaggacgaugcggauuccuuucucuuuucaccgcagacgacucgcccga

SEQ ID NO: 13074 - RNA, 52 nt, Artificial Sequence
  Description of Artificial Sequence: Synthetic oligonucleotide
gggaggacgaugcgguuacuuucuuuuuucccaccccagacgacucgcccga

SEQ ID NO: 13075 - RNA, 52 nt, Artificial Sequence
  Description of Artificial Sequence: Synthetic oligonucleotide
gggaggacgaugcggguugcuuuuuauguuuuaccgcagacgacucgcccga

SEQ ID NO: 13076 - RNA, 51 nt, Artificial Sequence
  Description of Artificial Sequence: Synthetic oligonucleotide
gggaggacgaugcgguuucaucuauucuacuuccgcagacgacucgcccga

SEQ ID NO: 13077 - RNA, 52 nt, Artificial Sequence
  Description of Artificial Sequence: Synthetic oligonucleotide
gggaggacgaugcggacucuuuuuuugcuucuuccgcagacgacucgcccga

SEQ ID NO: 13078 - RNA, 52 nt, Artificial Sequence
  Description of Artificial Sequence: Synthetic oligonucleotide
gggaggacgaugcggaguuucguguuuuuuuugccccagacgacucgcccga

SEQ ID NO: 13079 - RNA, 52 nt, Artificial Sequence
  Description of Artificial Sequence: Synthetic oligonucleotide
gggaggacgaugcgguuuuccgaagucuuuuuuccgcagacgacucgcccga

SEQ ID NO: 13080 - RNA, 52 nt, Artificial Sequence
  Description of Artificial Sequence: Synthetic oligonucleotide
gggaggacgaugcggauuccacuuuuuuuuccaccgcagacgacucgcccga

SEQ ID NO: 13081 - RNA, 51 nt, Artificial Sequence
  Description of Artificial Sequence: Synthetic oligonucleotide
gggaggacgaugcggucauuuuuccaguuuuuccccagacgacucgcccga

SEQ ID NO: 13082 - RNA, 51 nt, Artificial Sequence
  Description of Artificial Sequence: Synthetic oligonucleotide
gggaggacgaugcggacuuuauuucccuuauucugcagacgacucgcccga

SEQ ID NO: 13083 - RNA, 51 nt, Artificial Sequence
  Description of Artificial Sequence: Synthetic oligonucleotide
gggaggacgaugcgguacuauuuuuacuuccuccgcagacgacucgcccga

SEQ ID NO: 13084 - RNA, 51 nt, Artificial Sequence
  Description of Artificial Sequence: Synthetic oligonucleotide
gggaggacgaugcggcuuuucuuucuccuucaccgcagacgacucgcccga

SEQ ID NO: 13085 - RNA, 51 nt, Artificial Sequence
  Description of Artificial Sequence: Synthetic oligonucleotide
gggaggacgaugcgguuauuuuuguuuguuugucccagacgacucgcccga

SEQ ID NO: 13086 - RNA, 53 nt, Artificial Sequence
  Description of Artificial Sequence: Synthetic oligonucleotide
gggaggacgaugcgguuuucacuucauuuuuuuugcccagacgacucgcccga

SEQ ID NO: 13087 - RNA, 51 nt, Artificial Sequence
  Description of Artificial Sequence: Synthetic oligonucleotide
gggaggacgaugcggauuuaauccuuucuucaccgcagacgacucgcccga

SEQ ID NO: 13088 - RNA, 51 nt, Artificial Sequence
  Description of Artificial Sequence: Synthetic oligonucleotide
gggaggacgaugcggcuucuuuauucuuuucucugcagacgacucgcccga

SEQ ID NO: 13089 - RNA, 51 nt, Artificial Sequence
  Description of Artificial Sequence: Synthetic oligonucleotide
gggaggacgaugcggguuuuccgugcucuuuuccgcagacgacucgcccga

SEQ ID NO: 13090 - RNA, 51 nt, Artificial Sequence
  Description of Artificial Sequence: Synthetic oligonucleotide
gggaggacgaugcgguauucuuucuuuuucaaccccagacgacucgcccga

SEQ ID NO: 13091 - RNA, 51 nt, Artificial Sequence
  Description of Artificial Sequence: Synthetic oligonucleotide
gggaggacgaugcgguuuuuagcugucuuuuuccgcagacgacucgcccga

SEQ ID NO: 13092 - RNA, 51 nt, Artificial Sequence
  Description of Artificial Sequence: Synthetic oligonucleotide
gggaggacgaugcggauuuuuguuucguuugccugcagacgacucgcccga

SEQ ID NO: 13093 - RNA, 51 nt, Artificial Sequence
  Description of Artificial Sequence: Synthetic oligonucleotide
gggaggacgaugcggguuuacuuuuuacucugccgcagacgacucgcccga

SEQ ID NO: 13094 - RNA, 51 nt, Artificial Sequence
  Description of Artificial Sequence: Synthetic oligonucleotide
gggaggacgaugcggacuuuacucuuccuuuaccgcagacgacucgcccga

SEQ ID NO: 13095 - RNA, 51 nt, Artificial Sequence
  Description of Artificial Sequence: Synthetic oligonucleotide
gggaggacgaugcggguacuauuucuuuccuuccgcagacgacucgcccga

SEQ ID NO: 13096 - RNA, 51 nt, Artificial Sequence
  Description of Artificial Sequence: Synthetic oligonucleotide
gggaggacgaugcggacuuuuccugacuuauuccgcagacgacucgcccga

SEQ ID NO: 13097 - RNA, 51 nt, Artificial Sequence
  Description of Artificial Sequence: Synthetic oligonucleotide
gggaggacgaugcggcauucuuuuuuacuuuuccccagacgacucgcccga

SEQ ID NO: 13098 - RNA, 53 nt, Artificial Sequence
  Description of Artificial Sequence: Synthetic oligonucleotide
gggaggacgaugcgguuuuuguuacguuuuuuuugcgcagacgacucgcccga

SEQ ID NO: 13099 - RNA, 51 nt, Artificial Sequence
  Description of Artificial Sequence: Synthetic oligonucleotide
gggaggacgaugcggguccauauuuucuucuuccgcagacgacucgcccga

SEQ ID NO: 13100 - RNA, 51 nt, Artificial Sequence
  Description of Artificial Sequence: Synthetic oligonucleotide
gggaggacgaugcgguuauuuuuauuuucccuguacagacgacucgcccga

SEQ ID NO: 13101 - RNA, 51 nt, Artificial Sequence
  Description of Artificial Sequence: Synthetic oligonucleotide
gggaggacgaugcgguuuucaugaaguuuuuuccgcagacgacucgcccga

SEQ ID NO: 13102 - RNA, 51 nt, Artificial Sequence
  Description of Artificial Sequence: Synthetic oligonucleotide
gggaggacgaugcggauuuuuuguuuccuuugccgcagacgacucgcccga

SEQ ID NO: 13103 - RNA, 52 nt, Artificial Sequence
  Description of Artificial Sequence: Synthetic oligonucleotide
gggaggacgaugcgguuuuucuacucuuuuuuuccgcagacgacucgcccga

SEQ ID NO: 13104 - RNA, 51 nt, Artificial Sequence
  Description of Artificial Sequence: Synthetic oligonucleotide
gggaggacgaugcggcuuuuuucgucucuuuuccgcagacgacucgcccga

SEQ ID NO: 13105 - RNA, 52 nt, Artificial Sequence
  Description of Artificial Sequence: Synthetic oligonucleotide
gggaggacgaugcgguuauuuuccuuuuuucugccgcagacgacucgcccga

SEQ ID NO: 13106 - RNA, 51 nt, Artificial Sequence
  Description of Artificial Sequence: Synthetic oligonucleotide
gggaggacgaugcgguauguucuuuuuuugucccgcagacgacucgcccga

SEQ ID NO: 13107 - RNA, 49 nt, Artificial Sequence
  Description of Artificial Sequence: Synthetic oligonucleotide
gggaggacgaugcggauuuucuucuucuuaccgcagacgacucgcccga

SEQ ID NO: 13108 - RNA, 51 nt, Artificial Sequence
  Description of Artificial Sequence: Synthetic oligonucleotide
gggaggacgaugcggauuacuuaauacuuuuugcccagacgacucgcccga

SEQ ID NO: 13109 - RNA, 51 nt, Artificial Sequence
  Description of Artificial Sequence: Synthetic oligonucleotide
gggaggacgaugcggcuuucucucuauuuauuccgcagacgacucgcccga

SEQ ID NO: 13110 - RNA, 51 nt, Artificial Sequence
  Description of Artificial Sequence: Synthetic oligonucleotide
gggaggacgaugcgguucuaaucauuucuuuuccccagacgacucgcccga

SEQ ID NO: 13111 - RNA, 51 nt, Artificial Sequence
  Description of Artificial Sequence: Synthetic oligonucleotide
gggaggacgaugcgguuuuauuucuuuccauuccccagacgacucgcccga

SEQ ID NO: 13112 - RNA, 52 nt, Artificial Sequence
  Description of Artificial Sequence: Synthetic oligonucleotide
gggaggacgaugcggacuucuuuauuuuuucuuccgcagacgacucgcccga

SEQ ID NO: 13113 - RNA, 51 nt, Artificial Sequence
  Description of Artificial Sequence: Synthetic oligonucleotide
gggaggacgaugcggauauucuuuuuucucagcugcagacgacucgcccga

SEQ ID NO: 13114 - RNA, 51 nt, Artificial Sequence
  Description of Artificial Sequence: Synthetic oligonucleotide
gggaggacgaugcggacaucauuuucuuuuuaccccagacgacucgcccga

SEQ ID NO: 13115 - RNA, 52 nt, Artificial Sequence
  Description of Artificial Sequence: Synthetic oligonucleotide
gggaggacgaugcgguuuucacuuuuuuuucggcugcagacgacucgcccga

SEQ ID NO: 13116 - RNA, 51 nt, Artificial Sequence
  Description of Artificial Sequence: Synthetic oligonucleotide
gggaggacgaugcgguuuuccuaguuuuuuccccgcagacgacucgcccga

SEQ ID NO: 13117 - RNA, 51 nt, Artificial Sequence
  Description of Artificial Sequence: Synthetic oligonucleotide
gggaggacgaugcggccuuuuuacuuucucuuccgcagacgacucgcccga

SEQ ID NO: 13118 - RNA, 51 nt, Artificial Sequence
  Description of Artificial Sequence: Synthetic oligonucleotide
gggaggacgaugcgguuuguuuuccucuuuuuccgcagacgacucgcccga

SEQ ID NO: 13119 - RNA, 51 nt, Artificial Sequence
  Description of Artificial Sequence: Synthetic oligonucleotide
gggaggacgaugcggcuuucuugcucucuuucccgcagacgacucgcccga

SEQ ID NO: 13120 - RNA, 51 nt, Artificial Sequence
  Description of Artificial Sequence: Synthetic oligonucleotide
gggaggacgaugcgguuuuauuacuucuuguucugcagacgacucgcccga

SEQ ID NO: 13121 - RNA, 51 nt, Artificial Sequence
  Description of Artificial Sequence: Synthetic oligonucleotide
gggaggacgaugcgguuuuaauuuuuuccuucgugcagacgacucgcccga

SEQ ID NO: 13122 - RNA, 51 nt, Artificial Sequence
  Description of Artificial Sequence: Synthetic oligonucleotide
gggaggacgaugcgggcuuuuuuucucuuucccugcagacgacucgcccga

SEQ ID NO: 13123 - RNA, 51 nt, Artificial Sequence
  Description of Artificial Sequence: Synthetic oligonucleotide
gggaggacgaugcgguuuucacuauuuuuauucgccagacgacucgcccga

SEQ ID NO: 13124 - RNA, 51 nt, Artificial Sequence
  Description of Artificial Sequence: Synthetic oligonucleotide
gggaggacgaugcgguccugucgucugcuuguccccagacgacucgcccga

SEQ ID NO: 13125 - RNA, 50 nt, Artificial Sequence
  Description of Artificial Sequence: Synthetic oligonucleotide
gggaggacgaugcggccuuucguucuucccuccccagacgacucgcccga

SEQ ID NO: 13126 - RNA, 51 nt, Artificial Sequence
  Description of Artificial Sequence: Synthetic oligonucleotide
gggaggacgaugcggugagucguuccccucguccccagacgacucgcccga

SEQ ID NO: 13127 - RNA, 51 nt, Artificial Sequence
  Description of Artificial Sequence: Synthetic oligonucleotide
gggaggacgaugcgggcuuuucguucuacccuccccagacgacucgcccga

SEQ ID NO: 13128 - RNA, 49 nt, Artificial Sequence
  Description of Artificial Sequence: Synthetic oligonucleotide
gggaggacgaugcggauucacuuuuucuugccgcagacgacucgcccga

SEQ ID NO: 13129 - RNA, 51 nt, Artificial Sequence
  Description of Artificial Sequence: Synthetic oligonucleotide
gggaggacgaugcggcuuuccuugcuuucccuccgcagacgacucgcccga

SEQ ID NO: 13130 - RNA, 51 nt, Artificial Sequence
  Description of Artificial Sequence: Synthetic oligonucleotide
gggaggacgaugcgguuuuauuaucuccgucuccgcagacgacucgcccga

SEQ ID NO: 13131 - RNA, 51 nt, Artificial Sequence
  Description of Artificial Sequence: Synthetic oligonucleotide
gggaggacgaugcgguuugaagggugauguguccccagacgacucgcccga

SEQ ID NO: 13132 - RNA, 52 nt, Artificial Sequence
  Description of Artificial Sequence: Synthetic oligonucleotide
gggaggacgaugcgguacauucuuuuuuucucuccgcagacgacucgcccga

SEQ ID NO: 13133 - RNA, 51 nt, Artificial Sequence
  Description of Artificial Sequence: Synthetic oligonucleotide
gggaggacgaugcggcuauucuauacuccuuuccgcagacgacucgcccga

SEQ ID NO: 13134 - RNA, 50 nt, Artificial Sequence
  Description of Artificial Sequence: Synthetic oligonucleotide
gggaggacgaugcggcacuucuuucucuuauccgcagacgacucgcccga

SEQ ID NO: 13135 - RNA, 51 nt, Artificial Sequence
  Description of Artificial Sequence: Synthetic oligonucleotide
gggaggacgaugcgguccuuucguucugccucccccagacgacucgcccga

SEQ ID NO: 13136 - RNA, 51 nt, Artificial Sequence
  Description of Artificial Sequence: Synthetic oligonucleotide
gggaggacgaugcgguuuuuguuguauugguuccgcagacgacucgcccga

SEQ ID NO: 13137 - RNA, 51 nt, Artificial Sequence
  Description of Artificial Sequence: Synthetic oligonucleotide
gggaggacgaugcggccaucuacuuucacuuuccgcagacgacucgcccga

SEQ ID NO: 13138 - RNA, 51 nt, Artificial Sequence
  Description of Artificial Sequence: Synthetic oligonucleotide
gggaggacgaugcgguuuguucuuguuuuuguccgcagacgacucgcccga

SEQ ID NO: 13139 - RNA, 51 nt, Artificial Sequence
  Description of Artificial Sequence: Synthetic oligonucleotide
gggaggacgaugcggguucuuuauucccucuaccgcagacgacucgcccga

SEQ ID NO: 13140 - RNA, 51 nt, Artificial Sequence
  Description of Artificial Sequence: Synthetic oligonucleotide
gggaggacgaugcggguuauuguuugcuuguaccgcagacgacucgcccga

SEQ ID NO: 13141 - RNA, 51 nt, Artificial Sequence
  Description of Artificial Sequence: Synthetic oligonucleotide
gggaggacgaugcgguacucuuuucucuuaccccgcagacgacucgcccga

SEQ ID NO: 13142 - RNA, 50 nt, Artificial Sequence
  Description of Artificial Sequence: Synthetic oligonucleotide
gggaggacgaugcgguuuggguuuucccgugccgcagacgacucgcccga

SEQ ID NO: 13143 - RNA, 49 nt, Artificial Sequence
  Description of Artificial Sequence: Synthetic oligonucleotide
gggaggacgaugcgguuucuuguucucuuuccgcagacgacucgcccga

SEQ ID NO: 13144 - RNA, 51 nt, Artificial Sequence
  Description of Artificial Sequence: Synthetic oligonucleotide
gggaggacgaugcggucuauuuguguucuuuuccccagacgacucgcccga

SEQ ID NO: 13145 - RNA, 51 nt, Artificial Sequence
  Description of Artificial Sequence: Synthetic oligonucleotide
gggaggacgaugcgguccuuuuauucuucuccccgcagacgacucgcccga

SEQ ID NO: 13146 - RNA, 51 nt, Artificial Sequence
  Description of Artificial Sequence: Synthetic oligonucleotide
gggaggacgaugcgguccauuucuguuuuuccccgcagacgacucgcccga

SEQ ID NO: 13147 - RNA, 49 nt, Artificial Sequence
  Description of Artificial Sequence: Synthetic oligonucleotide
gggaggacgaugcgguaguguuuuuuuugugcccagacgacucgcccga

SEQ ID NO: 13148 - RNA, 52 nt, Artificial Sequence
  Description of Artificial Sequence: Synthetic oligonucleotide
gggaggacgaugcggguuuucuuguuucuuguuccucagacgacucgcccga

SEQ ID NO: 13149 - RNA, 51 nt, Artificial Sequence
  Description of Artificial Sequence: Synthetic oligonucleotide
gggaggacgaugcggauucuuuuuuuuucccaccgcagacgacucgcccga

SEQ ID NO: 13150 - RNA, 51 nt, Artificial Sequence
  Description of Artificial Sequence: Synthetic oligonucleotide
gggaggacgaugcggucucuauauacauuucuccgcagacgacucgcccga

SEQ ID NO: 13151 - RNA, 52 nt, Artificial Sequence
  Description of Artificial Sequence: Synthetic oligonucleotide
gggaggacgaugcgguuuguugccccuuuuuuuccgcagacgacucgcccga

SEQ ID NO: 13152 - RNA, 51 nt, Artificial Sequence
  Description of Artificial Sequence: Synthetic oligonucleotide
gggaggacgaugcgguuuugcuacuuuuacuuccccagacgacucgcccga

SEQ ID NO: 13153 - RNA, 51 nt, Artificial Sequence
  Description of Artificial Sequence: Synthetic oligonucleotide
gggaggacgaugcggucuuuuauuauguucuucugcagacgacucgcccga

SEQ ID NO: 13154 - RNA, 51 nt, Artificial Sequence
  Description of Artificial Sequence: Synthetic oligonucleotide
gggaggacgaugcggaccuuuuguuauuuaucccgcagacgacucgcccga

SEQ ID NO: 13155 - RNA, 51 nt, Artificial Sequence
  Description of Artificial Sequence: Synthetic oligonucleotide
gggaggacgaugcggcguauuuuuuauucuuugcccagacgacucgcccga

SEQ ID NO: 13156 - RNA, 51 nt, Artificial Sequence
  Description of Artificial Sequence: Synthetic oligonucleotide
gggaggacgaugcggucauucuuuuucucauugugcagacgacucgcccga

SEQ ID NO: 13157 - RNA, 51 nt, Artificial Sequence
  Description of Artificial Sequence: Synthetic oligonucleotide
gggaggacgaugcggaccgcuguuuauuuuuuccgcagacgacucgcccga

SEQ ID NO: 13158 - RNA, 51 nt, Artificial Sequence
  Description of Artificial Sequence: Synthetic oligonucleotide
gggaggacgaugcggauugucucuuuauuguaccgcagacgacucgcccga

SEQ ID NO: 13159 - RNA, 51 nt, Artificial Sequence
  Description of Artificial Sequence: Synthetic oligonucleotide
gggaggacgaugcggauuuuuauauugcuuccccgcagacgacucgcccga

SEQ ID NO: 13160 - RNA, 51 nt, Artificial Sequence
  Description of Artificial Sequence: Synthetic oligonucleotide
gggaggacgaugcgguucgugucauuuuucuuccgcagacgacucgcccga

SEQ ID NO: 13161 - RNA, 52 nt, Artificial Sequence
  Description of Artificial Sequence: Synthetic oligonucleotide
gggaggacgaugcgguuuuuucauuuuuucacgcugcagacgacucgcccga

SEQ ID NO: 13162 - RNA, 51 nt, Artificial Sequence
  Description of Artificial Sequence: Synthetic oligonucleotide
gggaggacgaugcggccuuuucgcucacuuuuccgcagacgacucgcccga

SEQ ID NO: 13163 - RNA, 51 nt, Artificial Sequence
  Description of Artificial Sequence: Synthetic oligonucleotide
gggaggacgaugcggguuugucauucuuuauuccgcagacgacucgcccga

SEQ ID NO: 13164 - RNA, 51 nt, Artificial Sequence
  Description of Artificial Sequence: Synthetic oligonucleotide
gggaggacgaugcggcuuuuugccuuuauucuccgcagacgacucgcccga

SEQ ID NO: 13165 - RNA, 51 nt, Artificial Sequence
  Description of Artificial Sequence: Synthetic oligonucleotide
gggaggacgaugcgguauuguauuuuuuguucccgcagacgacucgcccga

SEQ ID NO: 13166 - RNA, 50 nt, Artificial Sequence
  Description of Artificial Sequence: Synthetic oligonucleotide
gggaggacgaugcgguuucuuuucauuuuuuccgcagacgacucgcccga

SEQ ID NO: 13167 - RNA, 51 nt, Artificial Sequence
  Description of Artificial Sequence: Synthetic oligonucleotide
gggaggacgaugcggccuuuucucgcuguuauccgcagacgacucgcccga

SEQ ID NO: 13168 - RNA, 51 nt, Artificial Sequence
  Description of Artificial Sequence: Synthetic oligonucleotide
gggaggacgaugcgguuucuuucuucuuguucccgcagacgacucgcccga

SEQ ID NO: 13169 - RNA, 50 nt, Artificial Sequence
  Description of Artificial Sequence: Synthetic oligonucleotide
gggaggacgaugcggucuauuuccuuucuuuccgcagacgacucgcccga

SEQ ID NO: 13170 - RNA, 51 nt, Artificial Sequence
  Description of Artificial Sequence: Synthetic oligonucleotide
gggaggacgaugcgguuuguuuccauuauuguccgcagacgacucgcccga

SEQ ID NO: 13171 - RNA, 51 nt, Artificial Sequence
  Description of Artificial Sequence: Synthetic oligonucleotide
gggaggacgaugcggcccuuuauuuauuucuaccgcagacgacucgcccga

SEQ ID NO: 13172 - RNA, 51 nt, Artificial Sequence
  Description of Artificial Sequence: Synthetic oligonucleotide
gggaggacgaugcgguuucucuuucucucuuuccgcagacgacucgcccga

SEQ ID NO: 13173 - RNA, 51 nt, Artificial Sequence
  Description of Artificial Sequence: Synthetic oligonucleotide
gggaggacgaugcggucucuuuauuucuucuuccgcagacgacucgcccga

SEQ ID NO: 13174 - RNA, 51 nt, Artificial Sequence
  Description of Artificial Sequence: Synthetic oligonucleotide
gggaggacgaugcgguucauuuucauuuuucugcgcagacgacucgcccga

SEQ ID NO: 13175 - RNA, 52 nt, Artificial Sequence
  Description of Artificial Sequence: Synthetic oligonucleotide
gggaggacgaugcgguuauccuuguuuuuuuauccccagacgacucgcccga

SEQ ID NO: 13176 - RNA, 51 nt, Artificial Sequence
  Description of Artificial Sequence: Synthetic oligonucleotide
gggaggacgaugcgguuuucucucuucaucuuccgcagacgacucgcccga

SEQ ID NO: 13177 - RNA, 51 nt, Artificial Sequence
  Description of Artificial Sequence: Synthetic oligonucleotide
gggaggacgaugcgguaguauguuuuuguuuugugcagacgacucgcccga

SEQ ID NO: 13178 - RNA, 51 nt, Artificial Sequence
  Description of Artificial Sequence: Synthetic oligonucleotide
gggaggacgaugcggucuuuucgcuuuacuuaccgcagacgacucgcccga

SEQ ID NO: 13179 - RNA, 51 nt, Artificial Sequence
  Description of Artificial Sequence: Synthetic oligonucleotide
gggaggacgaugcgguaucuauuuacacuuuuccgcagacgacucgcccga

SEQ ID NO: 13180 - RNA, 51 nt, Artificial Sequence
  Description of Artificial Sequence: Synthetic oligonucleotide
gggaggacgaugcggucuuuauucucacuuucccgcagacgacucgcccga

SEQ ID NO: 13181 - RNA, 51 nt, Artificial Sequence
  Description of Artificial Sequence: Synthetic oligonucleotide
gggaggacgaugcgguacuuuuauacuuuuugccacagacgacucgcccga

SEQ ID NO: 13182 - RNA, 51 nt, Artificial Sequence
  Description of Artificial Sequence: Synthetic oligonucleotide
gggaggacgaugcggaucuuuuuuguucuugucugcagacgacucgcccga

SEQ ID NO: 13183 - RNA, 51 nt, Artificial Sequence
  Description of Artificial Sequence: Synthetic oligonucleotide
gggaggacgaugcgguacuuuuuuuuuccacuccgcagacgacucgcccga

SEQ ID NO: 13184 - RNA, 51 nt, Artificial Sequence
  Description of Artificial Sequence: Synthetic oligonucleotide
gggaggacgaugcggguucuuuucuuccgcuaccgcagacgacucgcccga

SEQ ID NO: 13185 - RNA, 51 nt, Artificial Sequence
  Description of Artificial Sequence: Synthetic oligonucleotide
gggaggacgaugcggaucuucuuuguuuuuuaccccagacgacucgcccga

SEQ ID NO: 13186 - RNA, 52 nt, Artificial Sequence
  Description of Artificial Sequence: Synthetic oligonucleotide
gggaggacgaugcgguuuuuuugucuaucuuuuccgcagacgacucgcccga

SEQ ID NO: 13187 - RNA, 51 nt, Artificial Sequence
  Description of Artificial Sequence: Synthetic oligonucleotide
gggaggacgaugcgguuuauuuacuuuguuucccccagacgacucgcccga

SEQ ID NO: 13188 - RNA, 51 nt, Artificial Sequence
  Description of Artificial Sequence: Synthetic oligonucleotide
gggaggacgaugcgguuucacucucuuuuucgcgucagacgacucgcccga

SEQ ID NO: 13189 - RNA, 50 nt, Artificial Sequence
  Description of Artificial Sequence: Synthetic oligonucleotide
gggaggacgaugcgguuucuuucuauucuuuccgcagacgacucgcccga

SEQ ID NO: 13190 - RNA, 51 nt, Artificial Sequence
  Description of Artificial Sequence: Synthetic oligonucleotide
gggaggacgaugcgguuauuuuaucacuuuugcgccagacgacucgcccga

SEQ ID NO: 13191 - RNA, 51 nt, Artificial Sequence
  Description of Artificial Sequence: Synthetic oligonucleotide
gggaggacgaugcggucauuugcucauuuccuccgcagacgacucgcccga

SEQ ID NO: 13192 - RNA, 51 nt, Artificial Sequence
  Description of Artificial Sequence: Synthetic oligonucleotide
gggaggacgaugcgggguuacuuuaucuuuugccgcagacgacucgcccga

SEQ ID NO: 13193 - RNA, 51 nt, Artificial Sequence
  Description of Artificial Sequence: Synthetic oligonucleotide
gggaggacgaugcggacuauuguuuucucuuuccccagacgacucgcccga

SEQ ID NO: 13194 - RNA, 51 nt, Artificial Sequence
  Description of Artificial Sequence: Synthetic oligonucleotide
gggaggacgaugcggucuuucaaucuucuauuccgcagacgacucgcccga

SEQ ID NO: 13195 - RNA, 51 nt, Artificial Sequence
  Description of Artificial Sequence: Synthetic oligonucleotide
gggaggacgaugcggacuucuuucacuucuuucugcagacgacucgcccga

SEQ ID NO: 13196 - RNA, 51 nt, Artificial Sequence
  Description of Artificial Sequence: Synthetic oligonucleotide
gggaggacgaugcgguuuauuuuucuugccccccgcagacgacucgcccga

SEQ ID NO: 13197 - RNA, 51 nt, Artificial Sequence
  Description of Artificial Sequence: Synthetic oligonucleotide
gggaggacgaugcggucucuuguuuauuuuucccccagacgacucgcccga

SEQ ID NO: 13198 - RNA, 51 nt, Artificial Sequence
  Description of Artificial Sequence: Synthetic oligonucleotide
gggaggacgaugcggucuuaacuucuuuuccucugcagacgacucgcccga

SEQ ID NO: 13199 - RNA, 51 nt, Artificial Sequence
  Description of Artificial Sequence: Synthetic oligonucleotide
gggaggacgaugcggucuuuucaaccuuuuacccgcagacgacucgcccga

SEQ ID NO: 13200 - RNA, 51 nt, Artificial Sequence
  Description of Artificial Sequence: Synthetic oligonucleotide
gggaggacgaugcgguuuucuauuaucuucuugugcagacgacucgcccga

SEQ ID NO: 13201 - RNA, 50 nt, Artificial Sequence
  Description of Artificial Sequence: Synthetic oligonucleotide
gggaggacgaugcgguuuuugauucuuguuuccgcagacgacucgcccga

SEQ ID NO: 13202 - RNA, 51 nt, Artificial Sequence
  Description of Artificial Sequence: Synthetic oligonucleotide
gggaggacgaugcggucuuuauuguuuuuuuaccccagacgacucgcccga

SEQ ID NO: 13203 - RNA, 51 nt, Artificial Sequence
  Description of Artificial Sequence: Synthetic oligonucleotide
gggaggacgaugcgguuuucuuuauguuguuguugcagacgacucgcccga

SEQ ID NO: 13204 - RNA, 51 nt, Artificial Sequence
  Description of Artificial Sequence: Synthetic oligonucleotide
gggaggacgaugcggccuuuauuuuuaucuuaccgcagacgacucgcccga

SEQ ID NO: 13205 - RNA, 51 nt, Artificial Sequence
  Description of Artificial Sequence: Synthetic oligonucleotide
gggaggacgaugcgguuguuuuucuauuguuugcgcagacgacucgcccga

SEQ ID NO: 13206 - RNA, 52 nt, Artificial Sequence
  Description of Artificial Sequence: Synthetic oligonucleotide
gggaggacgaugcgguuucucagcuuuuuuuuuccgcagacgacucgcccga

SEQ ID NO: 13207 - RNA, 51 nt, Artificial Sequence
  Description of Artificial Sequence: Synthetic oligonucleotide
gggaggacgaugcggcuuuuuaucuuacuuuuccccagacgacucgcccga

SEQ ID NO: 13208 - RNA, 51 nt, Artificial Sequence
  Description of Artificial Sequence: Synthetic oligonucleotide
gggaggacgaugcgguccugucggcuguugguccccagacgacucgcccga

SEQ ID NO: 13209 - RNA, 53 nt, Artificial Sequence
  Description of Artificial Sequence: Synthetic oligonucleotide
gggaggacgaugcggguccugucgucuguuucguccccagacgacucgcccga

SEQ ID NO: 13210 - RNA, 51 nt, Artificial Sequence
  Description of Artificial Sequence: Synthetic oligonucleotide
gggaggacgaugcggucuugucgucuuugcguccccagacgacucgcccga

SEQ ID NO: 13211 - RNA, 51 nt, Artificial Sequence
  Description of Artificial Sequence: Synthetic oligonucleotide
gggaggacgaugcgguccugucgucuuugcgcccccagacgacucgcccga

SEQ ID NO: 13212 - RNA, 51 nt, Artificial Sequence
  Description of Artificial Sequence: Synthetic oligonucleotide
gggaggacgaugcgguccugucgucuguucgguuccagacgacucgcccga

SEQ ID NO: 13213 - RNA, 51 nt, Artificial Sequence
  Description of Artificial Sequence: Synthetic oligonucleotide
gggaggacgaugcggcgauuccucuguuucguccccagacgacucgcccga

SEQ ID NO: 13214 - RNA, 51 nt, Artificial Sequence
  Description of Artificial Sequence: Synthetic oligonucleotide
gggaggacgaugcggugagucgcucccuucguccccagacgacucgcccga

SEQ ID NO: 13215 - RNA, 51 nt, Artificial Sequence
  Description of Artificial Sequence: Synthetic oligonucleotide
gggaggacgaugcggcgcuuuucuuuuucucgccccagacgacucgcccga

SEQ ID NO: 13216 - RNA, 51 nt, Artificial Sequence
  Description of Artificial Sequence: Synthetic oligonucleotide
gggaggacgaugcgguuugggauuaggguguuccgcagacgacucgcccga

SEQ ID NO: 13217 - RNA, 50 nt, Artificial Sequence
  Description of Artificial Sequence: Synthetic oligonucleotide
gggaggacgaugcgguuugggaguagguguuccgcagacgacucgcccga

SEQ ID NO: 13218 - RNA, 51 nt, Artificial Sequence
  Description of Artificial Sequence: Synthetic oligonucleotide
gggaggacgaugcgguuucuuuaauuuccccgccgcagacgacucgcccga

SEQ ID NO: 13219 - RNA, 51 nt, Artificial Sequence
  Description of Artificial Sequence: Synthetic oligonucleotide
gggaggacgaugcgguuugguguagggggguuccgcagacgacucgcccga

SEQ ID NO: 13220 - RNA, 51 nt, Artificial Sequence
  Description of Artificial Sequence: Synthetic oligonucleotide
gggaggacgaugcgguuuauuccacuuucucuccgcagacgacucgcccga

SEQ ID NO: 13221 - RNA, 51 nt, Artificial Sequence
  Description of Artificial Sequence: Synthetic oligonucleotide
gggaggacgaugcgguguuuauuuuguucuugccgcagacgacucgcccga

SEQ ID NO: 13222 - RNA, 51 nt, Artificial Sequence
  Description of Artificial Sequence: Synthetic oligonucleotide
gggaggacgaugcggguucuuauuuccucuguccgcagacgacucgcccga

SEQ ID NO: 13223 - RNA, 51 nt, Artificial Sequence
  Description of Artificial Sequence: Synthetic oligonucleotide
gggaggacgaugcggaaucuuuguauuuuucgccgcagacgacucgcccga

SEQ ID NO: 13224 - RNA, 51 nt, Artificial Sequence
  Description of Artificial Sequence: Synthetic oligonucleotide
gggaggacgaugcgguuauuuuaucucuggcuccgcagacgacucgcccga

SEQ ID NO: 13225 - RNA, 51 nt, Artificial Sequence
  Description of Artificial Sequence: Synthetic oligonucleotide
gggaggacgaugcggccguuucaucuuuuuuaccgcagacgacucgcccga

SEQ ID NO: 13226 - RNA, 51 nt, Artificial Sequence
  Description of Artificial Sequence: Synthetic oligonucleotide
gggaggacgaugcggucucgcuuucuuuuacuccgcagacgacucgcccga

SEQ ID NO: 13227 - RNA, 51 nt, Artificial Sequence
  Description of Artificial Sequence: Synthetic oligonucleotide
gggaggacgaugcggucuuucauuucuuuccccgccagacgacucgcccga

SEQ ID NO: 13228 - RNA, 50 nt, Artificial Sequence
  Description of Artificial Sequence: Synthetic oligonucleotide
gggaggacgaugcggcuuuuauuguuuccuuccgcagacgacucgcccga

SEQ ID NO: 13229 - RNA, 51 nt, Artificial Sequence
  Description of Artificial Sequence: Synthetic oligonucleotide
gggaggacgaugcggucauuuuguuaucuuuugugcagacgacucgcccga

SEQ ID NO: 13230 - RNA, 51 nt, Artificial Sequence
  Description of Artificial Sequence: Synthetic oligonucleotide
gggaggacgaugcggucgcuuucauucauuuuccgcagacgacucgcccga

SEQ ID NO: 13231 - RNA, 51 nt, Artificial Sequence
  Description of Artificial Sequence: Synthetic oligonucleotide
gggaggacgaugcgggcucuuucaccuuucuuccgcagacgacucgcccga

SEQ ID NO: 13232 - RNA, 51 nt, Artificial Sequence
  Description of Artificial Sequence: Synthetic oligonucleotide
gggaggacgaugcggauauaucauucuuuucaccccagacgacucgcccga

SEQ ID NO: 13233 - RNA, 51 nt, Artificial Sequence
  Description of Artificial Sequence: Synthetic oligonucleotide
gggaggacgaugcggcccuuuuauccuguuuuccgcagacgacucgcccga

SEQ ID NO: 13234 - RNA, 51 nt, Artificial Sequence
  Description of Artificial Sequence: Synthetic oligonucleotide
gggaggacgaugcggaacacuuucuuucucuaccgcagacgacucgcccga

SEQ ID NO: 13235 - RNA, 51 nt, Artificial Sequence
  Description of Artificial Sequence: Synthetic oligonucleotide
gggaggacgaugcggauaacuuuuuacucucaccgcagacgacucgcccga

SEQ ID NO: 13236 - RNA, 51 nt, Artificial Sequence
  Description of Artificial Sequence: Synthetic oligonucleotide
gggaggacgaugcgguuuucuuucaaccuuugccgcagacgacucgcccga

SEQ ID NO: 13237 - RNA, 51 nt, Artificial Sequence
  Description of Artificial Sequence: Synthetic oligonucleotide
gggaggacgaugcggucuuuuugucacuucuccgccagacgacucgcccga

SEQ ID NO: 13238 - RNA, 51 nt, Artificial Sequence
  Description of Artificial Sequence: Synthetic oligonucleotide
gggaggacgaugcggcuuaucuucauuuuuuaccgcagacgacucgcccga

SEQ ID NO: 13239 - RNA, 52 nt, Artificial Sequence
  Description of Artificial Sequence: Synthetic oligonucleotide
gggaggacgaugcggacucuguuuuuuuuccuuccgcagacgacucgcccga

SEQ ID NO: 13240 - RNA, 51 nt, Artificial Sequence
  Description of Artificial Sequence: Synthetic oligonucleotide
gggaggacgaugcggguuuuguaucuuuguuaccgcagacgacucgcccga

SEQ ID NO: 13241 - RNA, 51 nt, Artificial Sequence
  Description of Artificial Sequence: Synthetic oligonucleotide
gggaggacgaugcggucuauuuucuuucucuaccccagacgacucgcccga

SEQ ID NO: 13242 - RNA, 51 nt, Artificial Sequence
  Description of Artificial Sequence: Synthetic oligonucleotide
gggaggacgaugcgguuuccuuauauucuucugugcagacgacucgcccga

SEQ ID NO: 13243 - RNA, 51 nt, Artificial Sequence
  Description of Artificial Sequence: Synthetic oligonucleotide
gggaggacgaugcggguucuuuauucuauuccccgcagacgacucgcccga

SEQ ID NO: 13244 - RNA, 51 nt, Artificial Sequence
  Description of Artificial Sequence: Synthetic oligonucleotide
gggaggacgaugcgguguuuucuccguucuugccgcagacgacucgcccga

SEQ ID NO: 13245 - RNA, 51 nt, Artificial Sequence
  Description of Artificial Sequence: Synthetic oligonucleotide
gggaggacgaugcggauuccuuacuaucucuuccgcagacgacucgcccga

SEQ ID NO: 13246 - RNA, 50 nt, Artificial Sequence
  Description of Artificial Sequence: Synthetic oligonucleotide
gggaggacgaugcggucauuucucuccuuuuccgcagacgacucgcccga

SEQ ID NO: 13247 - RNA, 51 nt, Artificial Sequence
  Description of Artificial Sequence: Synthetic oligonucleotide
gggaggacgaugcggccuugucuuuuuuucuuccgcagacgacucgcccga

SEQ ID NO: 13248 - RNA, 52 nt, Artificial Sequence
  Description of Artificial Sequence: Synthetic oligonucleotide
gggaggacgaugcgguuuauuucuuuccacuuuccgcagacgacucgcccga

SEQ ID NO: 13249 - RNA, 51 nt, Artificial Sequence
  Description of Artificial Sequence: Synthetic oligonucleotide
gggaggacgaugcggccuuuuaguuccuuuuaccgcagacgacucgcccga

SEQ ID NO: 13250 - RNA, 51 nt, Artificial Sequence
  Description of Artificial Sequence: Synthetic oligonucleotide
gggaggacgaugcggacuuuauucucucacuuccgcagacgacucgcccga

SEQ ID NO: 13251 - RNA, 51 nt, Artificial Sequence
  Description of Artificial Sequence: Synthetic oligonucleotide
gggaggacgaugcggauuacauuuucauuucaccccagacgacucgcccga

SEQ ID NO: 13252 - RNA, 51 nt, Artificial Sequence
  Description of Artificial Sequence: Synthetic oligonucleotide
gggaggacgaugcgguuucucaauauuuucgcccgcagacgacucgcccga

SEQ ID NO: 13253 - RNA, 51 nt, Artificial Sequence
  Description of Artificial Sequence: Synthetic oligonucleotide
gggaggacgaugcgguuucacuuuucuuuuucccacagacgacucgcccga

SEQ ID NO: 13254 - RNA, 51 nt, Artificial Sequence
  Description of Artificial Sequence: Synthetic oligonucleotide
gggaggacgaugcggacauuccuuacuuuuuuccgcagacgacucgcccga

SEQ ID NO: 13255 - RNA, 52 nt, Artificial Sequence
  Description of Artificial Sequence: Synthetic oligonucleotide
gggaggacgaugcggauuuuguuuucguuuuugccacagacgacucgcccga

SEQ ID NO: 13256 - RNA, 51 nt, Artificial Sequence
  Description of Artificial Sequence: Synthetic oligonucleotide
gggaggacgaugcgguuuuaacucuuuucucucugcagacgacucgcccga

SEQ ID NO: 13257 - RNA, 51 nt, Artificial Sequence
  Description of Artificial Sequence: Synthetic oligonucleotide
gggaggacgaugcgguauucuuuuguuucuuuucgcagacgacucgcccga

SEQ ID NO: 13258 - RNA, 51 nt, Artificial Sequence
  Description of Artificial Sequence: Synthetic oligonucleotide
gggaggacgaugcgguuuauucuuauuuugcuccacagacgacucgcccga

SEQ ID NO: 13259 - RNA, 51 nt, Artificial Sequence
  Description of Artificial Sequence: Synthetic oligonucleotide
gggaggacgaugcgguuuccauucuuucauauccgcagacgacucgcccga

SEQ ID NO: 13260 - RNA, 51 nt, Artificial Sequence
  Description of Artificial Sequence: Synthetic oligonucleotide
gggaggacgaugcgguauauucuguuuuccuucugcagacgacucgcccga

SEQ ID NO: 13261 - RNA, 51 nt, Artificial Sequence
  Description of Artificial Sequence: Synthetic oligonucleotide
gggaggacgaugcggccuuuuuuauccccuuuccgcagacgacucgcccga

SEQ ID NO: 13262 - RNA, 51 nt, Artificial Sequence
  Description of Artificial Sequence: Synthetic oligonucleotide
gggaggacgaugcggcuuuuuuaguccuuuugccgcagacgacucgcccga

SEQ ID NO: 13263 - RNA, 51 nt, Artificial Sequence
  Description of Artificial Sequence: Synthetic oligonucleotide
gggaggacgaugcggcauuuaucucucuuuucccgcagacgacucgcccga

SEQ ID NO: 13264 - RNA, 51 nt, Artificial Sequence
  Description of Artificial Sequence: Synthetic oligonucleotide
gggaggacgaugcggauucuuaauuguuuuuaccgcagacgacucgcccga

SEQ ID NO: 13265 - RNA, 51 nt, Artificial Sequence
  Description of Artificial Sequence: Synthetic oligonucleotide
gggaggacgaugcgggaucuuuuauuuucacaccccagacgacucgcccga

SEQ ID NO: 13266 - RNA, 52 nt, Artificial Sequence
  Description of Artificial Sequence: Synthetic oligonucleotide
gggaggacgaugcggcuuucauuuuuuuucucuccgcagacgacucgcccga

SEQ ID NO: 13267 - RNA, 50 nt, Artificial Sequence
  Description of Artificial Sequence: Synthetic oligonucleotide
gggaggacgaugcgguucuucuuacuuccuuccgcagacgacucgcccga

SEQ ID NO: 13268 - RNA, 51 nt, Artificial Sequence
  Description of Artificial Sequence: Synthetic oligonucleotide
gggaggacgaugcggcuuuucuacuauuuaccccgcagacgacucgcccga

SEQ ID NO: 13269 - RNA, 51 nt, Artificial Sequence
  Description of Artificial Sequence: Synthetic oligonucleotide
gggaggacgaugcgguucucauucguuacuuuccgcagacgacucgcccga

SEQ ID NO: 13270 - RNA, 49 nt, Artificial Sequence
  Description of Artificial Sequence: Synthetic oligonucleotide
gggaggacgaugcggcuuuucuuucucuuuccgcagacgacucgcccga

SEQ ID NO: 13271 - RNA, 51 nt, Artificial Sequence
  Description of Artificial Sequence: Synthetic oligonucleotide
gggaggacgaugcggacuuugucuuuguuuuugcccagacgacucgcccga

SEQ ID NO: 13272 - RNA, 51 nt, Artificial Sequence
  Description of Artificial Sequence: Synthetic oligonucleotide
gggaggacgaugcggguuuuucaauuuucauuccgcagacgacucgcccga

SEQ ID NO: 13273 - RNA, 51 nt, Artificial Sequence
  Description of Artificial Sequence: Synthetic oligonucleotide
gggaggacgaugcgguuuuuguuuuauugccugcgcagacgacucgcccga

SEQ ID NO: 13274 - RNA, 51 nt, Artificial Sequence
  Description of Artificial Sequence: Synthetic oligonucleotide
gggaggacgaugcgguuucacuuuucucuucgccacagacgacucgcccga

SEQ ID NO: 13275 - RNA, 51 nt, Artificial Sequence
  Description of Artificial Sequence: Synthetic oligonucleotide
gggaggacgaugcggcguuuauauuuuccuucccgcagacgacucgcccga

SEQ ID NO: 13276 - RNA, 51 nt, Artificial Sequence
  Description of Artificial Sequence: Synthetic oligonucleotide
gggaggacgaugcggucauuucuuaguucuucccgcagacgacucgcccga

SEQ ID NO: 13277 - RNA, 51 nt, Artificial Sequence
  Description of Artificial Sequence: Synthetic oligonucleotide
gggaggacgaugcgguuuucuuuuaacacuuucugcagacgacucgcccga

SEQ ID NO: 13278 - RNA, 51 nt, Artificial Sequence
  Description of Artificial Sequence: Synthetic oligonucleotide
gggaggacgaugcggauuuauaucacucuuuugcccagacgacucgcccga

SEQ ID NO: 13279 - RNA, 51 nt, Artificial Sequence
  Description of Artificial Sequence: Synthetic oligonucleotide
gggaggacgaugcggaucuucacaauuuuucgccgcagacgacucgcccga

SEQ ID NO: 13280 - RNA, 51 nt, Artificial Sequence
  Description of Artificial Sequence: Synthetic oligonucleotide
gggaggacgaugcgguuuucuauuuuuccccuaugcagacgacucgcccga

SEQ ID NO: 13281 - RNA, 51 nt, Artificial Sequence
  Description of Artificial Sequence: Synthetic oligonucleotide
gggaggacgaugcgguccuuuguuucuuuaccccgcagacgacucgcccga

SEQ ID NO: 13282 - RNA, 51 nt, Artificial Sequence
  Description of Artificial Sequence: Synthetic oligonucleotide
gggaggacgaugcgguuuuauuucuauguguuccccagacgacucgcccga

SEQ ID NO: 13283 - RNA, 51 nt, Artificial Sequence
  Description of Artificial Sequence: Synthetic oligonucleotide
gggaggacgaugcgguuucuuccuguuuuuccccgcagacgacucgcccga

SEQ ID NO: 13284 - RNA, 51 nt, Artificial Sequence
  Description of Artificial Sequence: Synthetic oligonucleotide
gggaggacgaugcgguuugcucuuuucuuauuccccagacgacucgcccga

SEQ ID NO: 13285 - RNA, 51 nt, Artificial Sequence
  Description of Artificial Sequence: Synthetic oligonucleotide
gggaggacgaugcggcuuacuguuuuuucuuuccgcagacgacucgcccga

SEQ ID NO: 13286 - RNA, 51 nt, Artificial Sequence
  Description of Artificial Sequence: Synthetic oligonucleotide
gggaggacgaugcgguuuuuauuuuguuacaugugcagacgacucgcccga

SEQ ID NO: 13287 - RNA, 51 nt, Artificial Sequence
  Description of Artificial Sequence: Synthetic oligonucleotide
gggaggacgaugcggucuuauuuuguauuuucccgcagacgacucgcccga

SEQ ID NO: 13288 - RNA, 51 nt, Artificial Sequence
  Description of Artificial Sequence: Synthetic oligonucleotide
gggaggacgaugcggaauuauuuucuuucacacugcagacgacucgcccga

SEQ ID NO: 13289 - RNA, 51 nt, Artificial Sequence
  Description of Artificial Sequence: Synthetic oligonucleotide
gggaggacgaugcgguuuauuccauuuauuuuccgcagacgacucgcccga

SEQ ID NO: 13290 - RNA, 52 nt, Artificial Sequence
  Description of Artificial Sequence: Synthetic oligonucleotide
gggaggacgaugcgguuuauuuuuuucccguuugugcagacgacucgcccga

SEQ ID NO: 13291 - RNA, 51 nt, Artificial Sequence
  Description of Artificial Sequence: Synthetic oligonucleotide
gggaggacgaugcgguuuuuacuugauccuuucugcagacgacucgcccga

SEQ ID NO: 13292 - RNA, 51 nt, Artificial Sequence
  Description of Artificial Sequence: Synthetic oligonucleotide
gggaggacgaugcggauuuucuuuuuuuucugccgcagacgacucgcccga

SEQ ID NO: 13293 - RNA, 51 nt, Artificial Sequence
  Description of Artificial Sequence: Synthetic oligonucleotide
gggaggacgaugcggauauucguuguuucuucccgcagacgacucgcccga

SEQ ID NO: 13294 - RNA, 50 nt, Artificial Sequence
  Description of Artificial Sequence: Synthetic oligonucleotide
gggaggacgaugcgguuucucagcuuuuuuuccgcagacgacucgcccga

SEQ ID NO: 13295 - RNA, 51 nt, Artificial Sequence
  Description of Artificial Sequence: Synthetic oligonucleotide
gggaggacgaugcgguucuaauuuuauucccuccgcagacgacucgcccga

SEQ ID NO: 13296 - RNA, 52 nt, Artificial Sequence
  Description of Artificial Sequence: Synthetic oligonucleotide
gggaggacgaugcgguuauuuuuguuuuuuugcgugcagacgacucgcccga

SEQ ID NO: 13297 - RNA, 51 nt, Artificial Sequence
  Description of Artificial Sequence: Synthetic oligonucleotide
gggaggacgaugcggccuuuuucuuucuuuacccgcagacgacucgcccga

SEQ ID NO: 13298 - RNA, 53 nt, Artificial Sequence
  Description of Artificial Sequence: Synthetic oligonucleotide
gggaggacgaugcggauuccacuuuuuuuuuucaccgcagacgacucgcccga

SEQ ID NO: 13299 - RNA, 52 nt, Artificial Sequence
  Description of Artificial Sequence: Synthetic oligonucleotide
gggaggacgaugcggguuuuguuuuuuuccuuuccgcagacgacucgcccga

SEQ ID NO: 13300 - RNA, 51 nt, Artificial Sequence
  Description of Artificial Sequence: Synthetic oligonucleotide
gggaggacgaugcggguuuuuuuaucacuuuuccccagacgacucgcccga

SEQ ID NO: 13301 - RNA, 52 nt, Artificial Sequence
  Description of Artificial Sequence: Synthetic oligonucleotide
gggaggacgaugcgggauuuguuuuuuguuuuguaccagacgacucgcccga

SEQ ID NO: 13302 - RNA, 51 nt, Artificial Sequence
  Description of Artificial Sequence: Synthetic oligonucleotide
gggaggacgaugcgguucuuauuuucuuuucugugcagacgacucgcccga

SEQ ID NO: 13303 - RNA, 51 nt, Artificial Sequence
  Description of Artificial Sequence: Synthetic oligonucleotide
gggaggacgaugcggacuguucucuauuuuuaccgcagacgacucgcccga

SEQ ID NO: 13304 - RNA, 52 nt, Artificial Sequence
  Description of Artificial Sequence: Synthetic oligonucleotide
gggaggacgaugcgguauuuucuaccuuuuuuuccgcagacgacucgcccga

SEQ ID NO: 13305 - RNA, 50 nt, Artificial Sequence
  Description of Artificial Sequence: Synthetic oligonucleotide
gggaggacgaugcggauuuuauuguuuuuuaccgcagacgacucgcccga

SEQ ID NO: 13306 - RNA, 50 nt, Artificial Sequence
  Description of Artificial Sequence: Synthetic oligonucleotide
gggaggacgaugcgguucuuuauuuuuuccuccgcagacgacucgcccga

SEQ ID NO: 13307 - RNA, 52 nt, Artificial Sequence
  Description of Artificial Sequence: Synthetic oligonucleotide
gggaggacgaugcggauucucuuucuuuuuucaccgcagacgacucgcccga

SEQ ID NO: 13308 - RNA, 49 nt, Artificial Sequence
  Description of Artificial Sequence: Synthetic oligonucleotide
gggaggacgaugcgguuucaucuuuuuuuuccgcagacgacucgcccga

SEQ ID NO: 13309 - RNA, 51 nt, Artificial Sequence
  Description of Artificial Sequence: Synthetic oligonucleotide
gggaggacgaugcggcucuuuuuauguuuuuuccccagacgacucgcccga

SEQ ID NO: 13310 - RNA, 52 nt, Artificial Sequence
  Description of Artificial Sequence: Synthetic oligonucleotide
gggaggacgaugcgguuuucauucuuuuuuuucccccagacgacucgcccga

SEQ ID NO: 13311 - RNA, 51 nt, Artificial Sequence
  Description of Artificial Sequence: Synthetic oligonucleotide
gggaggacgaugcggcuucuuuuccauuauuuccgcagacgacucgcccga

SEQ ID NO: 13312 - RNA, 51 nt, Artificial Sequence
  Description of Artificial Sequence: Synthetic oligonucleotide
gggaggacgaugcggugagucguuccuuucguccccagacgacucgcccga

SEQ ID NO: 13313 - RNA, 51 nt, Artificial Sequence
  Description of Artificial Sequence: Synthetic oligonucleotide
gggaggacgaugcggugagucguuuccuucguccccagacgacucgcccga

SEQ ID NO: 13314 - RNA, 51 nt, Artificial Sequence
  Description of Artificial Sequence: Synthetic oligonucleotide
gggaggacgaugcgguccugucguccuugcguccccagacgacucgcccga

SEQ ID NO: 13315 - RNA, 51 nt, Artificial Sequence
  Description of Artificial Sequence: Synthetic oligonucleotide
gggaggacgaugcgguuugggguuuucccgugccacagacgacucgcccga

SEQ ID NO: 13316 - RNA, 50 nt, Artificial Sequence
  Description of Artificial Sequence: Synthetic oligonucleotide
gggaggacgaugcggauucacuucuuucuugccgcagacgacucgcccga

SEQ ID NO: 13317 - RNA, 51 nt, Artificial Sequence
  Description of Artificial Sequence: Synthetic oligonucleotide
gggaggacgaugcgguuuaauucauucccguuccgcagacgacucgcccga

SEQ ID NO: 13318 - RNA, 50 nt, Artificial Sequence
  Description of Artificial Sequence: Synthetic oligonucleotide
gggaggacgaugcgguucccuguuauuuucuccgcagacgacucgcccga

SEQ ID NO: 13319 - RNA, 51 nt, Artificial Sequence
  Description of Artificial Sequence: Synthetic oligonucleotide
gggaggacgaugcggcuuuuccuuuucccuauccgcagacgacucgcccga

SEQ ID NO: 13320 - RNA, 51 nt, Artificial Sequence
  Description of Artificial Sequence: Synthetic oligonucleotide
gggaggacgaugcgggucuccuggcuuaucguccccagacgacucgcccga

SEQ ID NO: 13321 - RNA, 50 nt, Artificial Sequence
  Description of Artificial Sequence: Synthetic oligonucleotide
gggaggacgaugcggauucuugccuuuuuugccgcagacgacucgcccga

SEQ ID NO: 13322 - RNA, 51 nt, Artificial Sequence
  Description of Artificial Sequence: Synthetic oligonucleotide
gggaggacgaugcgguuuccuugucuccauuuccgcagacgacucgcccga

SEQ ID NO: 13323 - RNA, 51 nt, Artificial Sequence
  Description of Artificial Sequence: Synthetic oligonucleotide
gggaggacgaugcggguuuuuaugcuuccucuccgcagacgacucgcccga

SEQ ID NO: 13324 - RNA, 51 nt, Artificial Sequence
  Description of Artificial Sequence: Synthetic oligonucleotide
gggaggacgaugcggcuuuauuuuuguuuuugccccagacgacucgcccga

SEQ ID NO: 13325 - RNA, 53 nt, Artificial Sequence
  Description of Artificial Sequence: Synthetic oligonucleotide
gggaggacgaugcggucuuguuuuuuuucuuugccgccagacgacucgcccga

SEQ ID NO: 13326 - RNA, 51 nt, Artificial Sequence
  Description of Artificial Sequence: Synthetic oligonucleotide
gggaggacgaugcgggauucuuguuacuuucaccccagacgacucgcccga

SEQ ID NO: 13327 - RNA, 51 nt, Artificial Sequence
  Description of Artificial Sequence: Synthetic oligonucleotide
gggaggacgaugcggucuuuucgaacuuguuuccgcagacgacucgcccga

SEQ ID NO: 13328 - RNA, 51 nt, Artificial Sequence
  Description of Artificial Sequence: Synthetic oligonucleotide
gggaggacgaugcggcuuucucuuccguuguuccgcagacgacucgcccga

SEQ ID NO: 13329 - RNA, 51 nt, Artificial Sequence
  Description of Artificial Sequence: Synthetic oligonucleotide
gggaggacgaugcgguuuuauuccuuuccgcuccgcagacgacucgcccga

SEQ ID NO: 13330 - RNA, 51 nt, Artificial Sequence
  Description of Artificial Sequence: Synthetic oligonucleotide
gggaggacgaugcggucuuauucgauuucccuccgcagacgacucgcccga

SEQ ID NO: 13331 - RNA, 51 nt, Artificial Sequence
  Description of Artificial Sequence: Synthetic oligonucleotide
gggaggacgaugcggguuuauucccuguuguuccgcagacgacucgcccga

SEQ ID NO: 13332 - RNA, 51 nt, Artificial Sequence
  Description of Artificial Sequence: Synthetic oligonucleotide
gggaggacgaugcggccuuuuaccucacuuauccgcagacgacucgcccga

SEQ ID NO: 13333 - RNA, 51 nt, Artificial Sequence
  Description of Artificial Sequence: Synthetic oligonucleotide
gggaggacgaugcgguuuuuauacauguuccuccgcagacgacucgcccga

SEQ ID NO: 13334 - RNA, 51 nt, Artificial Sequence
  Description of Artificial Sequence: Synthetic oligonucleotide
gggaggacgaugcggcuuuuauucucucuuccccgcagacgacucgcccga

SEQ ID NO: 13335 - RNA, 51 nt, Artificial Sequence
  Description of Artificial Sequence: Synthetic oligonucleotide
gggaggacgaugcggacuuuguuaccucuuuaccgcagacgacucgcccga

SEQ ID NO: 13336 - RNA, 51 nt, Artificial Sequence
  Description of Artificial Sequence: Synthetic oligonucleotide
gggaggacgaugcgguuacuuuucuaacuucuccgcagacgacucgcccga

SEQ ID NO: 13337 - RNA, 51 nt, Artificial Sequence
  Description of Artificial Sequence: Synthetic oligonucleotide
gggaggacgaugcggauucuccugcuuuucuuccgcagacgacucgcccga

SEQ ID NO: 13338 - RNA, 51 nt, Artificial Sequence
  Description of Artificial Sequence: Synthetic oligonucleotide
gggaggacgaugcggacuuucauacuuuuucaccgcagacgacucgcccga

SEQ ID NO: 13339 - RNA, 51 nt, Artificial Sequence
  Description of Artificial Sequence: Synthetic oligonucleotide
gggaggacgaugcgguauucuucuuucgcuuugugcagacgacucgcccga

SEQ ID NO: 13340 - RNA, 52 nt, Artificial Sequence
  Description of Artificial Sequence: Synthetic oligonucleotide
gggaggacgaugcggcuucuuguguuuuuuuugcugcagacgacucgcccga

SEQ ID NO: 13341 - RNA, 52 nt, Artificial Sequence
  Description of Artificial Sequence: Synthetic oligonucleotide
gggaggacgaugcgguuugaacucuuuuuuuuuccgcagacgacucgcccga

SEQ ID NO: 13342 - RNA, 51 nt, Artificial Sequence
  Description of Artificial Sequence: Synthetic oligonucleotide
gggaggacgaugcggccauguuuuccuuuuauccgcagacgacucgcccga

SEQ ID NO: 13343 - RNA, 53 nt, Artificial Sequence
  Description of Artificial Sequence: Synthetic oligonucleotide
gggaggacgaugcggaacuacuuuuuuucucucuccgcagacgacucgcccga

SEQ ID NO: 13344 - RNA, 53 nt, Artificial Sequence
  Description of Artificial Sequence: Synthetic oligonucleotide
gggaggacgaugcgguuuuucacuuuuuuucgccccgcagacgacucgcccga

SEQ ID NO: 13345 - RNA, 51 nt, Artificial Sequence
  Description of Artificial Sequence: Synthetic oligonucleotide
gggaggacgaugcggauuucuuuuccuuuuugccgcagacgacucgcccga

SEQ ID NO: 13346 - RNA, 53 nt, Artificial Sequence
  Description of Artificial Sequence: Synthetic oligonucleotide
gggaggacgaugcggucuuuuuuuuuuguuucccccgcagacgacucgcccga

SEQ ID NO: 13347 - RNA, 51 nt, Artificial Sequence
  Description of Artificial Sequence: Synthetic oligonucleotide
gggaggacgaugcgggauuuucuugccuuuuaccgcagacgacucgcccga

SEQ ID NO: 13348 - RNA, 51 nt, Artificial Sequence
  Description of Artificial Sequence: Synthetic oligonucleotide
gggaggacgaugcgguuuuuccuaucuccuugccgcagacgacucgcccga

SEQ ID NO: 13349 - RNA, 51 nt, Artificial Sequence
  Description of Artificial Sequence: Synthetic oligonucleotide
gggaggacgaugcgguuugguaguaggguguuccgcagacgacucgcccga

SEQ ID NO: 13350 - RNA, 51 nt, Artificial Sequence
  Description of Artificial Sequence: Synthetic oligonucleotide
gggaggacgaugcggguuuccucuucuuuuucccccagacgacucgcccga

SEQ ID NO: 13351 - RNA, 52 nt, Artificial Sequence
  Description of Artificial Sequence: Synthetic oligonucleotide
gggaggacgaugcgggauauuuacuuuuuuuuggcccagacgacucgcccga

SEQ ID NO: 13352 - RNA, 51 nt, Artificial Sequence
  Description of Artificial Sequence: Synthetic oligonucleotide
gggaggacgaugcggcucauuuacacuuauuuccgcagacgacucgcccga

SEQ ID NO: 13353 - RNA, 49 nt, Artificial Sequence
  Description of Artificial Sequence: Synthetic oligonucleotide
gggaggacgaugcggcuuguguuuuuuuuugcccagacgacucgcccga

SEQ ID NO: 13354 - RNA, 51 nt, Artificial Sequence
  Description of Artificial Sequence: Synthetic oligonucleotide
gggaggacgaugcgguuuuauucuuuuccguuccgcagacgacucgcccga

SEQ ID NO: 13355 - RNA, 51 nt, Artificial Sequence
  Description of Artificial Sequence: Synthetic oligonucleotide
gggaggacgaugcgguucuuuguuuauucccccugcagacgacucgcccga

SEQ ID NO: 13356 - RNA, 51 nt, Artificial Sequence
  Description of Artificial Sequence: Synthetic oligonucleotide
gggaggacgaugcggcuuuucuuuuuccucuucugcagacgacucgcccga

SEQ ID NO: 13357 - RNA, 51 nt, Artificial Sequence
  Description of Artificial Sequence: Synthetic oligonucleotide
gggaggacgaugcgguuuuuuucuacuuuucaccgcagacgacucgcccga

SEQ ID NO: 13358 - RNA, 51 nt, Artificial Sequence
  Description of Artificial Sequence: Synthetic oligonucleotide
gggaggacgaugcgguuucuuuauuguuuuugugccagacgacucgcccga

SEQ ID NO: 13359 - RNA, 52 nt, Artificial Sequence
  Description of Artificial Sequence: Synthetic oligonucleotide
gggaggacgaugcgguuuuuuuuucuguuuuccccgcagacgacucgcccga

SEQ ID NO: 13360 - RNA, 51 nt, Artificial Sequence
  Description of Artificial Sequence: Synthetic oligonucleotide
gggaggacgaugcggacuuucucuuuuguauuccgcagacgacucgcccga

SEQ ID NO: 13361 - RNA, 51 nt, Artificial Sequence
  Description of Artificial Sequence: Synthetic oligonucleotide
gggaggacgaugcgguauuuuuucagguuuccccgcagacgacucgcccga

SEQ ID NO: 13362 - RNA, 51 nt, Artificial Sequence
  Description of Artificial Sequence: Synthetic oligonucleotide
gggaggacgaugcgguucacuuuuucuuuuuugcgcagacgacucgcccga

SEQ ID NO: 13363 - RNA, 52 nt, Artificial Sequence
  Description of Artificial Sequence: Synthetic oligonucleotide
gggaggacgaugcggauugcguacuuuuuuuuuccgcagacgacucgcccga

SEQ ID NO: 13364 - RNA, 53 nt, Artificial Sequence
  Description of Artificial Sequence: Synthetic oligonucleotide
gggaggacgaugcggauuugcuuuuuuuuugauuccgcagacgacucgcccga

SEQ ID NO: 13365 - RNA, 51 nt, Artificial Sequence
  Description of Artificial Sequence: Synthetic oligonucleotide
gggaggacgaugcggguuucuacgacuuuuuuccgcagacgacucgcccga

SEQ ID NO: 13366 - RNA, 51 nt, Artificial Sequence
  Description of Artificial Sequence: Synthetic oligonucleotide
gggaggacgaugcggucacuuuuuuuucuaccccgcagacgacucgcccga

SEQ ID NO: 13367 - RNA, 51 nt, Artificial Sequence
  Description of Artificial Sequence: Synthetic oligonucleotide
gggaggacgaugcggauucuucucuacuuacaccgcagacgacucgcccga

SEQ ID NO: 13368 - RNA, 51 nt, Artificial Sequence
  Description of Artificial Sequence: Synthetic oligonucleotide
gggaggacgaugcgguaucuuuuaacuuuugcccgcagacgacucgcccga

SEQ ID NO: 13369 - RNA, 50 nt, Artificial Sequence
  Description of Artificial Sequence: Synthetic oligonucleotide
gggaggacgaugcgguguuuuauuuguuuuuccccagacgacucgcccga

SEQ ID NO: 13370 - RNA, 51 nt, Artificial Sequence
  Description of Artificial Sequence: Synthetic oligonucleotide
gggaggacgaugcgguaucuugcuucucuuuugcccagacgacucgcccga

SEQ ID NO: 13371 - RNA, 51 nt, Artificial Sequence
  Description of Artificial Sequence: Synthetic oligonucleotide
gggaggacgaugcggacuuuacuuuacucuuuccccagacgacucgcccga

SEQ ID NO: 13372 - RNA, 52 nt, Artificial Sequence
  Description of Artificial Sequence: Synthetic oligonucleotide
gggaggacgaugcggguuccauuuuuuuuuccaccgcagacgacucgcccga

SEQ ID NO: 13373 - RNA, 51 nt, Artificial Sequence
  Description of Artificial Sequence: Synthetic oligonucleotide
gggaggacgaugcggacugcuuuuacuuuuuuccccagacgacucgcccga

SEQ ID NO: 13374 - RNA, 52 nt, Artificial Sequence
  Description of Artificial Sequence: Synthetic oligonucleotide
gggaggacgaugcggaucuuuucgcuuuuuuuaccgcagacgacucgcccga

SEQ ID NO: 13375 - RNA, 53 nt, Artificial Sequence
  Description of Artificial Sequence: Synthetic oligonucleotide
gggaggacgaugcgguacuuuuuuuuuuuccacuccgcagacgacucgcccga

SEQ ID NO: 13376 - RNA, 53 nt, Artificial Sequence
  Description of Artificial Sequence: Synthetic oligonucleotide
gggaggacgaugcggauuuucauuuuuuuuuccgccgcagacgacucgcccga

SEQ ID NO: 13377 - RNA, 52 nt, Artificial Sequence
  Description of Artificial Sequence: Synthetic oligonucleotide
gggaggacgaugcggauuuugcuuuuuuuacuaccgcagacgacucgcccga

SEQ ID NO: 13378 - RNA, 51 nt, Artificial Sequence
  Description of Artificial Sequence: Synthetic oligonucleotide
gggaggacgaugcggcuuuuuacuacuuuucuccgcagacgacucgcccga

SEQ ID NO: 13379 - RNA, 52 nt, Artificial Sequence
  Description of Artificial Sequence: Synthetic oligonucleotide
gggaggacgaugcggucuauguuuauuuugucuccgcagacgacucgcccga

SEQ ID NO: 13380 - RNA, 52 nt, Artificial Sequence
  Description of Artificial Sequence: Synthetic oligonucleotide
gggaggacgaugcggauuuuuuccuguuuuuugccgcagacgacucgcccga

SEQ ID NO: 13381 - RNA, 51 nt, Artificial Sequence
  Description of Artificial Sequence: Synthetic oligonucleotide
gggaggacgaugcgguucuuuauuacuaucuuccgcagacgacucgcccga

SEQ ID NO: 13382 - RNA, 50 nt, Artificial Sequence
  Description of Artificial Sequence: Synthetic oligonucleotide
gggaggacgaugcgguuaccuuuuucuuuucccgcagacgacucgcccga

SEQ ID NO: 13383 - RNA, 51 nt, Artificial Sequence
  Description of Artificial Sequence: Synthetic oligonucleotide
gggaggacgaugcgguuuuuauuuuuguuugucggcagacgacucgcccga

SEQ ID NO: 13384 - RNA, 51 nt, Artificial Sequence
  Description of Artificial Sequence: Synthetic oligonucleotide
gggaggacgaugcggauuuuucuucaucuuuaccgcagacgacucgcccga

SEQ ID NO: 13385 - RNA, 51 nt, Artificial Sequence
  Description of Artificial Sequence: Synthetic oligonucleotide
gggaggacgaugcgguacuuuguucuucuucucugcagacgacucgcccga

SEQ ID NO: 13386 - RNA, 52 nt, Artificial Sequence
  Description of Artificial Sequence: Synthetic oligonucleotide
gggaggacgaugcggucuuuuucuaccuuuuuuccgcagacgacucgcccga

SEQ ID NO: 13387 - RNA, 51 nt, Artificial Sequence
  Description of Artificial Sequence: Synthetic oligonucleotide
gggaggacgaugcggcguuuuucacuuacuuuccgcagacgacucgcccga

SEQ ID NO: 13388 - RNA, 51 nt, Artificial Sequence
  Description of Artificial Sequence: Synthetic oligonucleotide
gggaggacgaugcggcuuuacuuauuucauuucugcagacgacucgcccga

SEQ ID NO: 13389 - RNA, 53 nt, Artificial Sequence
  Description of Artificial Sequence: Synthetic oligonucleotide
gggaggacgaugcggcuuuuuuuuuccuuuuuuuccgcagacgacucgcccga

SEQ ID NO: 13390 - RNA, 51 nt, Artificial Sequence
  Description of Artificial Sequence: Synthetic oligonucleotide
gggaggacgaugcggcauuuauuuuuuuccuuggccagacgacucgcccga

SEQ ID NO: 13391 - RNA, 52 nt, Artificial Sequence
  Description of Artificial Sequence: Synthetic oligonucleotide
gggaggacgaugcgguuucuuuuucacuucccuaugcagacgacucgcccga

SEQ ID NO: 13392 - RNA, 51 nt, Artificial Sequence
  Description of Artificial Sequence: Synthetic oligonucleotide
gggaggacgaugcggucauuucuuucuuauucccccagacgacucgcccga

SEQ ID NO: 13393 - RNA, 52 nt, Artificial Sequence
  Description of Artificial Sequence: Synthetic oligonucleotide
gggaggacgaugcgguuugguuuuaauuuuuucccgcagacgacucgcccga

SEQ ID NO: 13394 - RNA, 51 nt, Artificial Sequence
  Description of Artificial Sequence: Synthetic oligonucleotide
gggaggacgaugcggcauuucuuuuuucuuuuccgcagacgacucgcccga

SEQ ID NO: 13395 - RNA, 51 nt, Artificial Sequence
  Description of Artificial Sequence: Synthetic oligonucleotide
gggaggacgaugcggucucuuuguacuuacuuccgcagacgacucgcccga

SEQ ID NO: 13396 - RNA, 53 nt, Artificial Sequence
  Description of Artificial Sequence: Synthetic oligonucleotide
gggaggacgaugcgguacuucuuuuuuuuucucuccgcagacgacucgcccga

SEQ ID NO: 13397 - RNA, 51 nt, Artificial Sequence
  Description of Artificial Sequence: Synthetic oligonucleotide
gggaggacgaugcgguauucuuuauuauucuuguccagacgacucgcccga

SEQ ID NO: 13398 - RNA, 53 nt, Artificial Sequence
  Description of Artificial Sequence: Synthetic oligonucleotide
gggaggacgaugcggaucuacacuuuuuuuuuucccgcagacgacucgcccga

SEQ ID NO: 13399 - RNA, 50 nt, Artificial Sequence
  Description of Artificial Sequence: Synthetic oligonucleotide
gggaggacgaugcgguuuuaucuuucuuuuuccccagacgacucgcccga

SEQ ID NO: 13400 - RNA, 50 nt, Artificial Sequence
  Description of Artificial Sequence: Synthetic oligonucleotide
gggaggacgaugcggucuuuuaacuuuuucuccgcagacgacucgcccga

SEQ ID NO: 13401 - RNA, 50 nt, Artificial Sequence
  Description of Artificial Sequence: Synthetic oligonucleotide
gggaggacgaugcgguccuugugucuugcguccccagacgacucgcccga

SEQ ID NO: 13402 - RNA, 51 nt, Artificial Sequence
  Description of Artificial Sequence: Synthetic oligonucleotide
gggaggacgaugcgguuugggguuuuuccgugccccagacgacucgcccga

SEQ ID NO: 13403 - RNA, 51 nt, Artificial Sequence
  Description of Artificial Sequence: Synthetic oligonucleotide
gggaggacgaugcgguccugucgucucugcguccccagacgacucgcccga

SEQ ID NO: 13404 - RNA, 52 nt, Artificial Sequence
  Description of Artificial Sequence: Synthetic oligonucleotide
gggaggacgaugcgguuccugucgucuguucguccccagacgacucgcccga

SEQ ID NO: 13405 - RNA, 51 nt, Artificial Sequence
  Description of Artificial Sequence: Synthetic oligonucleotide
gggaggacgaugcggucauuguuuuuguguggccccagacgacucgcccga

SEQ ID NO: 13406 - RNA, 51 nt, Artificial Sequence
  Description of Artificial Sequence: Synthetic oligonucleotide
gggaggacgaugcgguucgaaggguguuggguccgcagacgacucgcccga

SEQ ID NO: 13407 - RNA, 52 nt, Artificial Sequence
  Description of Artificial Sequence: Synthetic oligonucleotide
gggaggacgaugcgguuuagcuuuuuuuucccuccgcagacgacucgcccga

SEQ ID NO: 13408 - RNA, 51 nt, Artificial Sequence
  Description of Artificial Sequence: Synthetic oligonucleotide
gggaggacgaugcggucacuuugccuuucuuuccgcagacgacucgcccga

SEQ ID NO: 13409 - RNA, 51 nt, Artificial Sequence
  Description of Artificial Sequence: Synthetic oligonucleotide
gggaggacgaugcggcuucuugcuuuuuucccccgcagacgacucgcccga

SEQ ID NO: 13410 - RNA, 53 nt, Artificial Sequence
  Description of Artificial Sequence: Synthetic oligonucleotide
gggaggacgaugcgguuucacucuuuuuuuuccccgccagacgacucgcccga

SEQ ID NO: 13411 - RNA, 51 nt, Artificial Sequence
  Description of Artificial Sequence: Synthetic oligonucleotide
gggaggacgaugcggucuguauucacuuuuuuccccagacgacucgcccga

SEQ ID NO: 13412 - RNA, 51 nt, Artificial Sequence
  Description of Artificial Sequence: Synthetic oligonucleotide
gggaggacgaugcgguuauucucauuuauccuccgcagacgacucgcccga

SEQ ID NO: 13413 - RNA, 51 nt, Artificial Sequence
  Description of Artificial Sequence: Synthetic oligonucleotide
gggaggacgaugcgggacuuuaccuucuuauuccccagacgacucgcccga

SEQ ID NO: 13414 - RNA, 51 nt, Artificial Sequence
  Description of Artificial Sequence: Synthetic oligonucleotide
gggaggacgaugcgguuccauucuuucuuauuccccagacgacucgcccga

SEQ ID NO: 13415 - RNA, 50 nt, Artificial Sequence
  Description of Artificial Sequence: Synthetic oligonucleotide
gggaggacgaugcggauucuuuucuuuuucaccgcagacgacucgcccga

SEQ ID NO: 13416 - RNA, 51 nt, Artificial Sequence
  Description of Artificial Sequence: Synthetic oligonucleotide
gggaggacgaugcgggucauugcuauuuuuuuccgcagacgacucgcccga

SEQ ID NO: 13417 - RNA, 53 nt, Artificial Sequence
  Description of Artificial Sequence: Synthetic oligonucleotide
gggaggacgaugcgguuuucuugcccuuuuuuuuccgcagacgacucgcccga

SEQ ID NO: 13418 - RNA, 51 nt, Artificial Sequence
  Description of Artificial Sequence: Synthetic oligonucleotide
gggaggacgaugcggauucuucuuucacuuaccgccagacgacucgcccga

SEQ ID NO: 13419 - RNA, 52 nt, Artificial Sequence
  Description of Artificial Sequence: Synthetic oligonucleotide
gggaggacgaugcggcuuuucucuucuuguuuaccucagacgacucgcccga

SEQ ID NO: 13420 - RNA, 51 nt, Artificial Sequence
  Description of Artificial Sequence: Synthetic oligonucleotide
gggaggacgaugcgggguuuucaaucuuuuccccccagacgacucgcccga

SEQ ID NO: 13421 - RNA, 51 nt, Artificial Sequence
  Description of Artificial Sequence: Synthetic oligonucleotide
gggaggacgaugcggaauacuucuuauucucuccgcagacgacucgcccga

SEQ ID NO: 13422 - RNA, 51 nt, Artificial Sequence
  Description of Artificial Sequence: Synthetic oligonucleotide
gggaggacgaugcggaucuuuucgcuuuuuugccgcagacgacucgcccga

SEQ ID NO: 13423 - RNA, 51 nt, Artificial Sequence
  Description of Artificial Sequence: Synthetic oligonucleotide
gggaggacgaugcggcuucucuauaacucucuccgcagacgacucgcccga

SEQ ID NO: 13424 - RNA, 52 nt, Artificial Sequence
  Description of Artificial Sequence: Synthetic oligonucleotide
gggaggacgaugcgguuuauuucuuuucacguuccgcagacgacucgcccga

SEQ ID NO: 13425 - RNA, 51 nt, Artificial Sequence
  Description of Artificial Sequence: Synthetic oligonucleotide
gggaggacgaugcggacuuauacuucucuucuccgcagacgacucgcccga

SEQ ID NO: 13426 - RNA, 51 nt, Artificial Sequence
  Description of Artificial Sequence: Synthetic oligonucleotide
gggaggacgaugcggguuuuuucccacuguucccgcagacgacucgcccga

SEQ ID NO: 13427 - RNA, 51 nt, Artificial Sequence
  Description of Artificial Sequence: Synthetic oligonucleotide
gggaggacgaugcggcucuuuuauacuuaucuccgcagacgacucgcccga

SEQ ID NO: 13428 - RNA, 51 nt, Artificial Sequence
  Description of Artificial Sequence: Synthetic oligonucleotide
gggaggacgaugcgguucuucacucacuuuucccgcagacgacucgcccga

SEQ ID NO: 13429 - RNA, 51 nt, Artificial Sequence
  Description of Artificial Sequence: Synthetic oligonucleotide
gggaggacgaugcgguuuuucuaaauuugcuuccgcagacgacucgcccga

SEQ ID NO: 13430 - RNA, 52 nt, Artificial Sequence
  Description of Artificial Sequence: Synthetic oligonucleotide
gggaggacgaugcggaucaucacuuucuuuuuaccgcagacgacucgcccga

SEQ ID NO: 13431 - RNA, 51 nt, Artificial Sequence
  Description of Artificial Sequence: Synthetic oligonucleotide
gggaggacgaugcggcucacuuucauuccauuccgcagacgacucgcccga

SEQ ID NO: 13432 - RNA, 51 nt, Artificial Sequence
  Description of Artificial Sequence: Synthetic oligonucleotide
gggaggacgaugcgguuucuuuucucgcuuuuccgcagacgacucgcccga

SEQ ID NO: 13433 - RNA, 51 nt, Artificial Sequence
  Description of Artificial Sequence: Synthetic oligonucleotide
gggaggacgaugcggauuuucuucucucuucuccgcagacgacucgcccga

SEQ ID NO: 13434 - RNA, 51 nt, Artificial Sequence
  Description of Artificial Sequence: Synthetic oligonucleotide
gggaggacgaugcggcauuuuacuauuucucuccgcagacgacucgcccga

SEQ ID NO: 13435 - RNA, 52 nt, Artificial Sequence
  Description of Artificial Sequence: Synthetic oligonucleotide
gggaggacgaugcgggucuugucuauuuuuuccccgcagacgacucgcccga

SEQ ID NO: 13436 - RNA, 51 nt, Artificial Sequence
  Description of Artificial Sequence: Synthetic oligonucleotide
gggaggacgaugcggucuuuauuuacggcuuuccgcagacgacucgcccga

SEQ ID NO: 13437 - RNA, 51 nt, Artificial Sequence
  Description of Artificial Sequence: Synthetic oligonucleotide
gggaggacgaugcggugguuggcguuauggaggugcagacgacucgcccga

SEQ ID NO: 13438 - RNA, 51 nt, Artificial Sequence
  Description of Artificial Sequence: Synthetic oligonucleotide
gggaggacgaugcggcuuuuuuuucaugcuuuccgcagacgacucgcccga

SEQ ID NO: 13439 - RNA, 51 nt, Artificial Sequence
  Description of Artificial Sequence: Synthetic oligonucleotide
gggaggacgaugcggauuuucucuuuuuuuugccgcagacgacucgcccga

SEQ ID NO: 13440 - RNA, 51 nt, Artificial Sequence
  Description of Artificial Sequence: Synthetic oligonucleotide
gggaggacgaugcggucacuucuuucuauuccccgcagacgacucgcccga

SEQ ID NO: 13441 - RNA, 50 nt, Artificial Sequence
  Description of Artificial Sequence: Synthetic oligonucleotide
gggaggacgaugcggaucuuuucuuucuuugccgcagacgacucgcccga

SEQ ID NO: 13442 - RNA, 52 nt, Artificial Sequence
  Description of Artificial Sequence: Synthetic oligonucleotide
gggaggacgaugcgguuucuugauccuuuuuuuccgcagacgacucgcccga

SEQ ID NO: 13443 - RNA, 51 nt, Artificial Sequence
  Description of Artificial Sequence: Synthetic oligonucleotide
gggaggacgaugcggcuuuuauguuucccuuuccgcagacgacucgcccga

SEQ ID NO: 13444 - RNA, 51 nt, Artificial Sequence
  Description of Artificial Sequence: Synthetic oligonucleotide
gggaggacgaugcggccuuauuuauuuucuuaccgcagacgacucgcccga

SEQ ID NO: 13445 - RNA, 51 nt, Artificial Sequence
  Description of Artificial Sequence: Synthetic oligonucleotide
gggaggacgaugcggcuucuuuucuuucucuugugcagacgacucgcccga

SEQ ID NO: 13446 - RNA, 49 nt, Artificial Sequence
  Description of Artificial Sequence: Synthetic oligonucleotide
gggaggacgaugcgguuucuuuuccuuuguccgcagacgacucgcccga

SEQ ID NO: 13447 - RNA, 52 nt, Artificial Sequence
  Description of Artificial Sequence: Synthetic oligonucleotide
gggaggacgaugcggauuccuuuucuuuuuucuccgcagacgacucgcccga

SEQ ID NO: 13448 - RNA, 51 nt, Artificial Sequence
  Description of Artificial Sequence: Synthetic oligonucleotide
gggaggacgaugcgguuuauuucacacucuuugcccagacgacucgcccga

SEQ ID NO: 13449 - RNA, 51 nt, Artificial Sequence
  Description of Artificial Sequence: Synthetic oligonucleotide
gggaggacgaugcggcuuucuauauauuccuuccgcagacgacucgcccga

SEQ ID NO: 13450 - RNA, 51 nt, Artificial Sequence
  Description of Artificial Sequence: Synthetic oligonucleotide
gggaggacgaugcggucuuuucuguuucugucccgcagacgacucgcccga

SEQ ID NO: 13451 - RNA, 51 nt, Artificial Sequence
  Description of Artificial Sequence: Synthetic oligonucleotide
gggaggacgaugcgguuuauuaucuuucucugcugcagacgacucgcccga

SEQ ID NO: 13452 - RNA, 51 nt, Artificial Sequence
  Description of Artificial Sequence: Synthetic oligonucleotide
gggaggacgaugcgguuuucuuucucucaucuccgcagacgacucgcccga

SEQ ID NO: 13453 - RNA, 51 nt, Artificial Sequence
  Description of Artificial Sequence: Synthetic oligonucleotide
gggaggacgaugcggauuauugcuuuuuuuugcugcagacgacucgcccga

SEQ ID NO: 13454 - RNA, 51 nt, Artificial Sequence
  Description of Artificial Sequence: Synthetic oligonucleotide
gggaggacgaugcgguuuauucuuuuuucuuugcgcagacgacucgcccga

SEQ ID NO: 13455 - RNA, 51 nt, Artificial Sequence
  Description of Artificial Sequence: Synthetic oligonucleotide
gggaggacgaugcggaguuucuuuucuuucuuccgcagacgacucgcccga

SEQ ID NO: 13456 - RNA, 51 nt, Artificial Sequence
  Description of Artificial Sequence: Synthetic oligonucleotide
gggaggacgaugcggaccuuauaacucuucuuccgcagacgacucgcccga

SEQ ID NO: 13457 - RNA, 51 nt, Artificial Sequence
  Description of Artificial Sequence: Synthetic oligonucleotide
gggaggacgaugcgguguucacguuuuuuuuucugcagacgacucgcccga

SEQ ID NO: 13458 - RNA, 51 nt, Artificial Sequence
  Description of Artificial Sequence: Synthetic oligonucleotide
gggaggacgaugcgggucuauuauuauuucugccgcagacgacucgcccga

SEQ ID NO: 13459 - RNA, 51 nt, Artificial Sequence
  Description of Artificial Sequence: Synthetic oligonucleotide
gggaggacgaugcgguucauacuuucuuucuugcccagacgacucgcccga

SEQ ID NO: 13460 - RNA, 51 nt, Artificial Sequence
  Description of Artificial Sequence: Synthetic oligonucleotide
gggaggacgaugcggaucuuuaucuucuucucccgcagacgacucgcccga

SEQ ID NO: 13461 - RNA, 50 nt, Artificial Sequence
  Description of Artificial Sequence: Synthetic oligonucleotide
gggaggacgaugcgguuauuuuuuuuucuguccgcagacgacucgcccga

SEQ ID NO: 13462 - RNA, 51 nt, Artificial Sequence
  Description of Artificial Sequence: Synthetic oligonucleotide
gggaggacgaugcgggacucuuuauuucuuuuccccagacgacucgcccga

SEQ ID NO: 13463 - RNA, 51 nt, Artificial Sequence
  Description of Artificial Sequence: Synthetic oligonucleotide
gggaggacgaugcggccuuuuuguuacuuuauccccagacgacucgcccga

SEQ ID NO: 13464 - RNA, 51 nt, Artificial Sequence
  Description of Artificial Sequence: Synthetic oligonucleotide
gggaggacgaugcgguuuuucauaacuuuccucugcagacgacucgcccga

SEQ ID NO: 13465 - RNA, 51 nt, Artificial Sequence
  Description of Artificial Sequence: Synthetic oligonucleotide
gggaggacgaugcggacacuuaucacuuuuuaccgcagacgacucgcccga

SEQ ID NO: 13466 - RNA, 51 nt, Artificial Sequence
  Description of Artificial Sequence: Synthetic oligonucleotide
gggaggacgaugcggcuagggugaaggguggaugccagacgacucgcccga

SEQ ID NO: 13467 - RNA, 51 nt, Artificial Sequence
  Description of Artificial Sequence: Synthetic oligonucleotide
gggaggacgaugcgguuuuaccucguuuuucugugcagacgacucgcccga

SEQ ID NO: 13468 - RNA, 49 nt, Artificial Sequence
  Description of Artificial Sequence: Synthetic oligonucleotide
gggaggacgaugcgggcuuucguucugccuccccagacgacucgcccga

SEQ ID NO: 13469 - RNA, 51 nt, Artificial Sequence
  Description of Artificial Sequence: Synthetic oligonucleotide
gggaggacgaugcggcuucauguuuagcuuucgcccagacgacucgcccga

SEQ ID NO: 13470 - RNA, 50 nt, Artificial Sequence
  Description of Artificial Sequence: Synthetic oligonucleotide
gggaggacgaugcggaucuuucuuucuucugccgcagacgacucgcccga

SEQ ID NO: 13471 - RNA, 52 nt, Artificial Sequence
  Description of Artificial Sequence: Synthetic oligonucleotide
gggaggacgaugcggauuucgcuaauuuuuuuaccgcagacgacucgcccga

SEQ ID NO: 13472 - RNA, 51 nt, Artificial Sequence
  Description of Artificial Sequence: Synthetic oligonucleotide
gggaggacgaugcgggccuucuuuucuuucucccgcagacgacucgcccga

SEQ ID NO: 13473 - RNA, 51 nt, Artificial Sequence
  Description of Artificial Sequence: Synthetic oligonucleotide
gggaggacgaugcgguuauucucuauucuuuugcccagacgacucgcccga

SEQ ID NO: 13474 - RNA, 51 nt, Artificial Sequence
  Description of Artificial Sequence: Synthetic oligonucleotide
gggaggacgaugcggucuuucauuuucucucucugcagacgacucgcccga

SEQ ID NO: 13475 - RNA, 53 nt, Artificial Sequence
  Description of Artificial Sequence: Synthetic oligonucleotide
gggaggacgaugcgguuuguaauguuuuuuuuuuccgcagacgacucgcccga

SEQ ID NO: 13476 - RNA, 53 nt, Artificial Sequence
  Description of Artificial Sequence: Synthetic oligonucleotide
gggaggacgaugcggucauuacuguuuuuuuuauccgcagacgacucgcccga

SEQ ID NO: 13477 - RNA, 53 nt, Artificial Sequence
  Description of Artificial Sequence: Synthetic oligonucleotide
gggaggacgaugcgguuuuuucacuuuuuucgccccgcagacgacucgcccga

SEQ ID NO: 13478 - RNA, 51 nt, Artificial Sequence
  Description of Artificial Sequence: Synthetic oligonucleotide
gggaggacgaugcggauuuuuuuugucgcuucccgcagacgacucgcccga

SEQ ID NO: 13479 - RNA, 49 nt, Artificial Sequence
  Description of Artificial Sequence: Synthetic oligonucleotide
gggaggacgaugcggauuucuuuuccuuuaccgcagacgacucgcccga

SEQ ID NO: 13480 - RNA, 51 nt, Artificial Sequence
  Description of Artificial Sequence: Synthetic oligonucleotide
gggaggacgaugcgguacucuuuuauuucuucccgcagacgacucgcccga

SEQ ID NO: 13481 - RNA, 52 nt, Artificial Sequence
  Description of Artificial Sequence: Synthetic oligonucleotide
gggaggacgaugcgguuucuuacuuuuuuucauccgcagacgacucgcccga

SEQ ID NO: 13482 - RNA, 52 nt, Artificial Sequence
  Description of Artificial Sequence: Synthetic oligonucleotide
gggaggacgaugcgguuuuucaauuauuucuguccgcagacgacucgcccga

SEQ ID NO: 13483 - RNA, 52 nt, Artificial Sequence
  Description of Artificial Sequence: Synthetic oligonucleotide
gggaggacgaugcgguuuuugucauuucuuguuccgcagacgacucgcccga

SEQ ID NO: 13484 - RNA, 51 nt, Artificial Sequence
  Description of Artificial Sequence: Synthetic oligonucleotide
gggaggacgaugcgguuuuaguuauguuuuguucccagacgacucgcccga

SEQ ID NO: 13485 - RNA, 51 nt, Artificial Sequence
  Description of Artificial Sequence: Synthetic oligonucleotide
gggaggacgaugcgguuucuuuucuacucauucugcagacgacucgcccga

SEQ ID NO: 13486 - RNA, 51 nt, Artificial Sequence
  Description of Artificial Sequence: Synthetic oligonucleotide
gggaggacgaugcggguuuuuuguaacugcuuccccagacgacucgcccga

SEQ ID NO: 13487 - RNA, 52 nt, Artificial Sequence
  Description of Artificial Sequence: Synthetic oligonucleotide
gggaggacgaugcgguuuuuuuuauuguuguuucugcagacgacucgcccga

SEQ ID NO: 13488 - RNA, 51 nt, Artificial Sequence
  Description of Artificial Sequence: Synthetic oligonucleotide
gggaggacgaugcggcucuuaucguuauuuuuccgcagacgacucgcccga

SEQ ID NO: 13489 - RNA, 52 nt, Artificial Sequence
  Description of Artificial Sequence: Synthetic oligonucleotide
gggaggacgaugcgguucacauuauuuuuuuuuccgcagacgacucgcccga

SEQ ID NO: 13490 - RNA, 51 nt, Artificial Sequence
  Description of Artificial Sequence: Synthetic oligonucleotide
gggaggacgaugcggcucauuaucuaucucuuccgcagacgacucgcccga

SEQ ID NO: 13491 - RNA, 51 nt, Artificial Sequence
  Description of Artificial Sequence: Synthetic oligonucleotide
gggaggacgaugcggucuuuuuaucacuauuuccccagacgacucgcccga

SEQ ID NO: 13492 - RNA, 53 nt, Artificial Sequence
  Description of Artificial Sequence: Synthetic oligonucleotide
gggaggacgaugcggccuuucauuuuuuuuuuugccgcagacgacucgcccga

SEQ ID NO: 13493 - RNA, 51 nt, Artificial Sequence
  Description of Artificial Sequence: Synthetic oligonucleotide
gggaggacgaugcgguauuguuuucucguuuugugcagacgacucgcccga

SEQ ID NO: 13494 - RNA, 51 nt, Artificial Sequence
  Description of Artificial Sequence: Synthetic oligonucleotide
gggaggacgaugcggcaucucuuucauuuuauccgcagacgacucgcccga

SEQ ID NO: 13495 - RNA, 52 nt, Artificial Sequence
  Description of Artificial Sequence: Synthetic oligonucleotide
gggaggacgaugcggguucuuucauguuuuuuuccccagacgacucgcccga

SEQ ID NO: 13496 - RNA, 53 nt, Artificial Sequence
  Description of Artificial Sequence: Synthetic oligonucleotide
gggaggacgaugcggaauuucucguuuuuuuuugcugcagacgacucgcccga

SEQ ID NO: 13497 - RNA, 51 nt, Artificial Sequence
  Description of Artificial Sequence: Synthetic oligonucleotide
gggaggacgaugcggguugcuuacuuuuuuuccgccagacgacucgcccga

SEQ ID NO: 13498 - RNA, 51 nt, Artificial Sequence
  Description of Artificial Sequence: Synthetic oligonucleotide
gggaggacgaugcgguuacucauuuuauuucuccgcagacgacucgcccga

SEQ ID NO: 13499 - RNA, 50 nt, Artificial Sequence
  Description of Artificial Sequence: Synthetic oligonucleotide
gggaggacgaugcgguuuuuccuuuuuuuauccgcagacgacucgcccga

SEQ ID NO: 13500 - RNA, 53 nt, Artificial Sequence
  Description of Artificial Sequence: Synthetic oligonucleotide
gggaggacgaugcggccauuuguuuuuuuuucuuccgcagacgacucgcccga

SEQ ID NO: 13501 - RNA, 51 nt, Artificial Sequence
  Description of Artificial Sequence: Synthetic oligonucleotide
gggaggacgaugcgguacuuuaaucuuuuuuuccgcagacgacucgcccga

SEQ ID NO: 13502 - RNA, 50 nt, Artificial Sequence
  Description of Artificial Sequence: Synthetic oligonucleotide
gggaggacgaugcggucguuuauuucuuuuuccgcagacgacucgcccga

SEQ ID NO: 13503 - RNA, 51 nt, Artificial Sequence
  Description of Artificial Sequence: Synthetic oligonucleotide
gggaggacgaugcggcuuucucuuuaauucuuccgcagacgacucgcccga

SEQ ID NO: 13504 - RNA, 50 nt, Artificial Sequence
  Description of Artificial Sequence: Synthetic oligonucleotide
gggaggacgaugcggccuuuuucuuuccuuuccgcagacgacucgcccga

SEQ ID NO: 13505 - RNA, 51 nt, Artificial Sequence
  Description of Artificial Sequence: Synthetic oligonucleotide
gggaggacgaugcgguccuugucguuuugcguccccagacgacucgcccga

SEQ ID NO: 13506 - RNA, 51 nt, Artificial Sequence
  Description of Artificial Sequence: Synthetic oligonucleotide
gggaggacgaugcgguccuuucguucugcccuccgcagacgacucgcccga

SEQ ID NO: 13507 - RNA, 50 nt, Artificial Sequence
  Description of Artificial Sequence: Synthetic oligonucleotide
gggaggacgaugcggucuucuggcuuaucguccccagacgacucgcccga

SEQ ID NO: 13508 - RNA, 49 nt, Artificial Sequence
  Description of Artificial Sequence: Synthetic oligonucleotide
gggaggacgaugcgguccuuucguugcccuccccagacgacucgcccga

SEQ ID NO: 13509 - RNA, 51 nt, Artificial Sequence
  Description of Artificial Sequence: Synthetic oligonucleotide
gggaggacgaugcgggcccuucguucuucccuccccagacgacucgcccga

SEQ ID NO: 13510 - RNA, 51 nt, Artificial Sequence
  Description of Artificial Sequence: Synthetic oligonucleotide
gggaggacgaugcgguccucucguucugcccuccccagacgacucgcccga

SEQ ID NO: 13511 - RNA, 51 nt, Artificial Sequence
  Description of Artificial Sequence: Synthetic oligonucleotide
gggaggacgaugcggauagucuggacuugccgccccagacgacucgcccga

SEQ ID NO: 13512 - RNA, 50 nt, Artificial Sequence
  Description of Artificial Sequence: Synthetic oligonucleotide
gggaggacgaugcgguccuggcuugucguguccccagacgacucgcccga

SEQ ID NO: 13513 - RNA, 50 nt, Artificial Sequence
  Description of Artificial Sequence: Synthetic oligonucleotide
gggaggacgaugcggucuuuugccuucuuuuccgcagacgacucgcccga

SEQ ID NO: 13514 - RNA, 51 nt, Artificial Sequence
  Description of Artificial Sequence: Synthetic oligonucleotide
gggaggacgaugcgguuucacuuuuauuucugccgcagacgacucgcccga

SEQ ID NO: 13515 - RNA, 51 nt, Artificial Sequence
  Description of Artificial Sequence: Synthetic oligonucleotide
gggaggacgaugcgguuugggaguagggugugccgcagacgacucgcccga

SEQ ID NO: 13516 - RNA, 52 nt, Artificial Sequence
  Description of Artificial Sequence: Synthetic oligonucleotide
gggaggacgaugcgguuugggguuuuucccgugccgcagacgacucgcccga

SEQ ID NO: 13517 - RNA, 52 nt, Artificial Sequence
  Description of Artificial Sequence: Synthetic oligonucleotide
gggaggacgaugcggauuugaagggugauggguccgcagacgacucgcccga

SEQ ID NO: 13518 - RNA, 51 nt, Artificial Sequence
  Description of Artificial Sequence: Synthetic oligonucleotide
gggaggacgaugcgguuuccauucaaucuucuccgcagacgacucgcccga

SEQ ID NO: 13519 - RNA, 51 nt, Artificial Sequence
  Description of Artificial Sequence: Synthetic oligonucleotide
gggaggacgaugcgguuuuugucuacuuuucgccgcagacgacucgcccga

SEQ ID NO: 13520 - RNA, 51 nt, Artificial Sequence
  Description of Artificial Sequence: Synthetic oligonucleotide
gggaggacgaugcggcuuuuccuuacuauuuugcccagacgacucgcccga

SEQ ID NO: 13521 - RNA, 51 nt, Artificial Sequence
  Description of Artificial Sequence: Synthetic oligonucleotide
gggaggacgaugcggaugcuuggaguagggaggcgcagacgacucgcccga

SEQ ID NO: 13522 - RNA, 51 nt, Artificial Sequence
  Description of Artificial Sequence: Synthetic oligonucleotide
gggaggacgaugcggucacuuuuuuacuuccugcccagacgacucgcccga

SEQ ID NO: 13523 - RNA, 50 nt, Artificial Sequence
  Description of Artificial Sequence: Synthetic oligonucleotide
gggaggacgaugcggaucuuucuuauuuuugccgcagacgacucgcccga

SEQ ID NO: 13524 - RNA, 50 nt, Artificial Sequence
  Description of Artificial Sequence: Synthetic oligonucleotide
gggaggacgaugcgguuugggguaggguguuccgcagacgacucgcccga

SEQ ID NO: 13525 - RNA, 49 nt, Artificial Sequence
  Description of Artificial Sequence: Synthetic oligonucleotide
gggaggacgaugcggucuuacuuuuucacuccgcagacgacucgcccga

SEQ ID NO: 13526 - RNA, 51 nt, Artificial Sequence
  Description of Artificial Sequence: Synthetic oligonucleotide
gggaggacgaugcgguuguuuucguuuuuuuugcccagacgacucgcccga

SEQ ID NO: 13527 - RNA, 49 nt, Artificial Sequence
  Description of Artificial Sequence: Synthetic oligonucleotide
gggaggacgaugcggguuucguucugcccuccccagacgacucgcccga

SEQ ID NO: 13528 - RNA, 52 nt, Artificial Sequence
  Description of Artificial Sequence: Synthetic oligonucleotide
gggaggacgaugcggcuuucacuuuuuuucucuccccagacgacucgcccga

SEQ ID NO: 13529 - RNA, 51 nt, Artificial Sequence
  Description of Artificial Sequence: Synthetic oligonucleotide
gggaggacgaugcggguuggcguagggggguuccgcagacgacucgcccga

SEQ ID NO: 13530 - RNA, 51 nt, Artificial Sequence
  Description of Artificial Sequence: Synthetic oligonucleotide
gggaggacgaugcgguuuuacucuuuuccgcuccgcagacgacucgcccga

SEQ ID NO: 13531 - RNA, 50 nt, Artificial Sequence
  Description of Artificial Sequence: Synthetic oligonucleotide
gggaggacgaugcggucuuuuuaacuuuucuccgcagacgacucgcccga

SEQ ID NO: 13532 - RNA, 52 nt, Artificial Sequence
  Description of Artificial Sequence: Synthetic oligonucleotide
gggaggacgaugcggauuugcuuuuuuuugguuccgcagacgacucgcccga

SEQ ID NO: 13533 - RNA, 51 nt, Artificial Sequence
  Description of Artificial Sequence: Synthetic oligonucleotide
gggaggacgaugcggcuuuauucuuguugucuccgcagacgacucgcccga

SEQ ID NO: 13534 - RNA, 51 nt, Artificial Sequence
  Description of Artificial Sequence: Synthetic oligonucleotide
gggaggacgaugcggcauucauuuucuuucuaccgcagacgacucgcccga

SEQ ID NO: 13535 - RNA, 49 nt, Artificial Sequence
  Description of Artificial Sequence: Synthetic oligonucleotide
gggaggacgaugcgguuucuuguuuccuuuccgcagacgacucgcccga

SEQ ID NO: 13536 - RNA, 51 nt, Artificial Sequence
  Description of Artificial Sequence: Synthetic oligonucleotide
gggaggacgaugcgguuauuuguauguuuuuuccgcagacgacucgcccga

SEQ ID NO: 13537 - RNA, 51 nt, Artificial Sequence
  Description of Artificial Sequence: Synthetic oligonucleotide
gggaggacgaugcggacuucgcuuuuauuuauccccagacgacucgcccga

SEQ ID NO: 13538 - RNA, 51 nt, Artificial Sequence
  Description of Artificial Sequence: Synthetic oligonucleotide
gggaggacgaugcggcucuuauucucucauuuccgcagacgacucgcccga

SEQ ID NO: 13539 - RNA, 51 nt, Artificial Sequence
  Description of Artificial Sequence: Synthetic oligonucleotide
gggaggacgaugcggauuuaauguucucuuuuccgcagacgacucgcccga

SEQ ID NO: 13540 - RNA, 52 nt, Artificial Sequence
  Description of Artificial Sequence: Synthetic oligonucleotide
gggaggacgaugcgguuuuuuguucccuuuugcccgcagacgacucgcccga

SEQ ID NO: 13541 - RNA, 51 nt, Artificial Sequence
  Description of Artificial Sequence: Synthetic oligonucleotide
gggaggacgaugcgguuuuguguuuuauguauccgcagacgacucgcccga

SEQ ID NO: 13542 - RNA, 51 nt, Artificial Sequence
  Description of Artificial Sequence: Synthetic oligonucleotide
gggaggacgaugcggaucauuuuuucaucccaccgcagacgacucgcccga

SEQ ID NO: 13543 - RNA, 51 nt, Artificial Sequence
  Description of Artificial Sequence: Synthetic oligonucleotide
gggaggacgaugcggaacuuuucuucucucguccgcagacgacucgcccga

SEQ ID NO: 13544 - RNA, 52 nt, Artificial Sequence
  Description of Artificial Sequence: Synthetic oligonucleotide
gggaggacgaugcggcuuguguuuuuuuuuuuugcccagacgacucgcccga

SEQ ID NO: 13545 - RNA, 51 nt, Artificial Sequence
  Description of Artificial Sequence: Synthetic oligonucleotide
gggaggacgaugcggauuuuuuugauccuucuccgcagacgacucgcccga

SEQ ID NO: 13546 - RNA, 52 nt, Artificial Sequence
  Description of Artificial Sequence: Synthetic oligonucleotide
gggaggacgaugcgggauuuuucuuuuuuugugccgcagacgacucgcccga

SEQ ID NO: 13547 - RNA, 51 nt, Artificial Sequence
  Description of Artificial Sequence: Synthetic oligonucleotide
gggaggacgaugcggcucuuucuucgcuuuucccgcagacgacucgcccga

SEQ ID NO: 13548 - RNA, 51 nt, Artificial Sequence
  Description of Artificial Sequence: Synthetic oligonucleotide
gggaggacgaugcgggcucuuuucuuucuucaccccagacgacucgcccga

SEQ ID NO: 13549 - RNA, 51 nt, Artificial Sequence
  Description of Artificial Sequence: Synthetic oligonucleotide
gggaggacgaugcggaucuuuucguuuuuuuaccgcagacgacucgcccga

SEQ ID NO: 13550 - RNA, 51 nt, Artificial Sequence
  Description of Artificial Sequence: Synthetic oligonucleotide
gggaggacgaugcgguaacuauuuucuuucugccccagacgacucgcccga

SEQ ID NO: 13551 - RNA, 51 nt, Artificial Sequence
  Description of Artificial Sequence: Synthetic oligonucleotide
gggaggacgaugcgguuuuugucuugcuuuuuccgcagacgacucgcccga

SEQ ID NO: 13552 - RNA, 51 nt, Artificial Sequence
  Description of Artificial Sequence: Synthetic oligonucleotide
gggaggacgaugcgguuucuuuucguuacuugccgcagacgacucgcccga

SEQ ID NO: 13553 - RNA, 51 nt, Artificial Sequence
  Description of Artificial Sequence: Synthetic oligonucleotide
gggaggacgaugcgggcucuauucuuuucccaccgcagacgacucgcccga

SEQ ID NO: 13554 - RNA, 52 nt, Artificial Sequence
  Description of Artificial Sequence: Synthetic oligonucleotide
gggaggacgaugcgggcuuuucuuccuuuuuuuccgcagacgacucgcccga

SEQ ID NO: 13555 - RNA, 51 nt, Artificial Sequence
  Description of Artificial Sequence: Synthetic oligonucleotide
gggaggacgaugcggaccuuuugauuuuuuugccccagacgacucgcccga

SEQ ID NO: 13556 - RNA, 51 nt, Artificial Sequence
  Description of Artificial Sequence: Synthetic oligonucleotide
gggaggacgaugcgggcuuucuuuacgcuuuuccccagacgacucgcccga

SEQ ID NO: 13557 - RNA, 51 nt, Artificial Sequence
  Description of Artificial Sequence: Synthetic oligonucleotide
gggaggacgaugcggauuauuucuuucguuugccgcagacgacucgcccga

SEQ ID NO: 13558 - RNA, 50 nt, Artificial Sequence
  Description of Artificial Sequence: Synthetic oligonucleotide
gggaggacgaugcggcguuuucuacuucuuuccgcagacgacucgcccga

SEQ ID NO: 13559 - RNA, 53 nt, Artificial Sequence
  Description of Artificial Sequence: Synthetic oligonucleotide
gggaggacgaugcggcuuucacuuuuuuuucccuccgcagacgacucgcccga

SEQ ID NO: 13560 - RNA, 53 nt, Artificial Sequence
  Description of Artificial Sequence: Synthetic oligonucleotide
gggaggacgaugcgguuuuucauucccuuuuuuuccgcagacgacucgcccga

SEQ ID NO: 13561 - RNA, 51 nt, Artificial Sequence
  Description of Artificial Sequence: Synthetic oligonucleotide
gggaggacgaugcgguuuggggggaggggguuccgcagacgacucgcccga

SEQ ID NO: 13562 - RNA, 51 nt, Artificial Sequence
  Description of Artificial Sequence: Synthetic oligonucleotide
gggaggacgaugcgguuuccuuugcuuucucuccgcagacgacucgcccga

SEQ ID NO: 13563 - RNA, 52 nt, Artificial Sequence
  Description of Artificial Sequence: Synthetic oligonucleotide
gggaggacgaugcggcaauuguuuuuuuuucaccgccagacgacucgcccga

SEQ ID NO: 13564 - RNA, 52 nt, Artificial Sequence
  Description of Artificial Sequence: Synthetic oligonucleotide
gggaggacgaugcgguucauuuuuuuauucccugugcagacgacucgcccga

SEQ ID NO: 13565 - RNA, 51 nt, Artificial Sequence
  Description of Artificial Sequence: Synthetic oligonucleotide
gggaggacgaugcggcauucuuuguucuucuacgccagacgacucgcccga

SEQ ID NO: 13566 - RNA, 52 nt, Artificial Sequence
  Description of Artificial Sequence: Synthetic oligonucleotide
gggaggacgaugcgguuuguucuuuucuuuuucccccagacgacucgcccga

SEQ ID NO: 13567 - RNA, 51 nt, Artificial Sequence
  Description of Artificial Sequence: Synthetic oligonucleotide
gggaggacgaugcgguucuuauuuaugucuuuccgcagacgacucgcccga

SEQ ID NO: 13568 - RNA, 51 nt, Artificial Sequence
  Description of Artificial Sequence: Synthetic oligonucleotide
gggaggacgaugcggaauucuauuuauuuuugccgcagacgacucgcccga

SEQ ID NO: 13569 - RNA, 51 nt, Artificial Sequence
  Description of Artificial Sequence: Synthetic oligonucleotide
gggaggacgaugcggccuuuauuauuuuuuacccgcagacgacucgcccga

SEQ ID NO: 13570 - RNA, 51 nt, Artificial Sequence
  Description of Artificial Sequence: Synthetic oligonucleotide
gggaggacgaugcggacuucuucauauucucaccgcagacgacucgcccga

SEQ ID NO: 13571 - RNA, 51 nt, Artificial Sequence
  Description of Artificial Sequence: Synthetic oligonucleotide
gggaggacgaugcggcuuuuucuauuuaguuuccgcagacgacucgcccga

SEQ ID NO: 13572 - RNA, 51 nt, Artificial Sequence
  Description of Artificial Sequence: Synthetic oligonucleotide
gggaggacgaugcggacuuguuguucuuuuuaccgcagacgacucgcccga

SEQ ID NO: 13573 - RNA, 52 nt, Artificial Sequence
  Description of Artificial Sequence: Synthetic oligonucleotide
gggaggacgaugcggacauuacuuuuuuuuuucccgcagacgacucgcccga

SEQ ID NO: 13574 - RNA, 51 nt, Artificial Sequence
  Description of Artificial Sequence: Synthetic oligonucleotide
gggaggacgaugcggcuuuuuguuuucuuuuacugcagacgacucgcccga

SEQ ID NO: 13575 - RNA, 51 nt, Artificial Sequence
  Description of Artificial Sequence: Synthetic oligonucleotide
gggaggacgaugcgguuuucgcuauuuuucaccgccagacgacucgcccga

SEQ ID NO: 13576 - RNA, 51 nt, Artificial Sequence
  Description of Artificial Sequence: Synthetic oligonucleotide
gggaggacgaugcgguuuucacuuucuuuuugcuccagacgacucgcccga

SEQ ID NO: 13577 - RNA, 51 nt, Artificial Sequence
  Description of Artificial Sequence: Synthetic oligonucleotide
gggaggacgaugcggucucauuugcuuuuaucccgcagacgacucgcccga

SEQ ID NO: 13578 - RNA, 51 nt, Artificial Sequence
  Description of Artificial Sequence: Synthetic oligonucleotide
gggaggacgaugcggacucuaguuuauuuucaccgcagacgacucgcccga

SEQ ID NO: 13579 - RNA, 52 nt, Artificial Sequence
  Description of Artificial Sequence: Synthetic oligonucleotide
gggaggacgaugcggacuuuuuucguuuuccaaccgcagacgacucgcccga

SEQ ID NO: 13580 - RNA, 51 nt, Artificial Sequence
  Description of Artificial Sequence: Synthetic oligonucleotide
gggaggacgaugcggacuuuucucgcacuuuaccgcagacgacucgcccga

SEQ ID NO: 13581 - RNA, 52 nt, Artificial Sequence
  Description of Artificial Sequence: Synthetic oligonucleotide
gggaggacgaugcggaaccuuguuuuucuuucaccgcagacgacucgcccga

SEQ ID NO: 13582 - RNA, 51 nt, Artificial Sequence
  Description of Artificial Sequence: Synthetic oligonucleotide
gggaggacgaugcggaauuccucauauuuucuccgcagacgacucgcccga

SEQ ID NO: 13583 - RNA, 51 nt, Artificial Sequence
  Description of Artificial Sequence: Synthetic oligonucleotide
gggaggacgaugcggguuucuauuucucuccgccgcagacgacucgcccga

SEQ ID NO: 13584 - RNA, 51 nt, Artificial Sequence
  Description of Artificial Sequence: Synthetic oligonucleotide
gggaggacgaugcggauacuuucuuuuuaccacugcagacgacucgcccga

SEQ ID NO: 13585 - RNA, 51 nt, Artificial Sequence
  Description of Artificial Sequence: Synthetic oligonucleotide
gggaggacgaugcggucuuguuacuuuucuuaccgcagacgacucgcccga

SEQ ID NO: 13586 - RNA, 51 nt, Artificial Sequence
  Description of Artificial Sequence: Synthetic oligonucleotide
gggaggacgaugcgguuuccaauccuuuccuuccgcagacgacucgcccga

SEQ ID NO: 13587 - RNA, 51 nt, Artificial Sequence
  Description of Artificial Sequence: Synthetic oligonucleotide
gggaggacgaugcgguuauuauuaucuuucugccccagacgacucgcccga

SEQ ID NO: 13588 - RNA, 51 nt, Artificial Sequence
  Description of Artificial Sequence: Synthetic oligonucleotide
gggaggacgaugcgguuucaaauuuuacuuuuccgcagacgacucgcccga

SEQ ID NO: 13589 - RNA, 51 nt, Artificial Sequence
  Description of Artificial Sequence: Synthetic oligonucleotide
gggaggacgaugcggucucuuuuucauuguucccgcagacgacucgcccga

SEQ ID NO: 13590 - RNA, 51 nt, Artificial Sequence
  Description of Artificial Sequence: Synthetic oligonucleotide
gggaggacgaugcgguuacuuuuucuuuuggcguccagacgacucgcccga

SEQ ID NO: 13591 - RNA, 51 nt, Artificial Sequence
  Description of Artificial Sequence: Synthetic oligonucleotide
gggaggacgaugcggccuuuuuuuuguucuucccgcagacgacucgcccga

SEQ ID NO: 13592 - RNA, 51 nt, Artificial Sequence
  Description of Artificial Sequence: Synthetic oligonucleotide
gggaggacgaugcggcauuuucuguuuuuuuuccgcagacgacucgcccga

SEQ ID NO: 13593 - RNA, 51 nt, Artificial Sequence
  Description of Artificial Sequence: Synthetic oligonucleotide
gggaggacgaugcgguuucaauuccccucuuuccgcagacgacucgcccga

SEQ ID NO: 13594 - RNA, 51 nt, Artificial Sequence
  Description of Artificial Sequence: Synthetic oligonucleotide
gggaggacgaugcggcauuuuccuuucuccuuccgcagacgacucgcccga

SEQ ID NO: 13595 - RNA, 51 nt, Artificial Sequence
  Description of Artificial Sequence: Synthetic oligonucleotide
gggaggacgaugcggguuauauuggcuuuuuuccgcagacgacucgcccga

SEQ ID NO: 13596 - RNA, 52 nt, Artificial Sequence
  Description of Artificial Sequence: Synthetic oligonucleotide
gggaggacgaugcggauauuuuguuuuuucuugccccagacgacucgcccga

SEQ ID NO: 13597 - RNA, 51 nt, Artificial Sequence
  Description of Artificial Sequence: Synthetic oligonucleotide
gggaggacgaugcgggauuuuuucucucuuuuccccagacgacucgcccga

SEQ ID NO: 13598 - RNA, 51 nt, Artificial Sequence
  Description of Artificial Sequence: Synthetic oligonucleotide
gggaggacgaugcggauuuuuccuuacccucuccgcagacgacucgcccga

SEQ ID NO: 13599 - RNA, 51 nt, Artificial Sequence
  Description of Artificial Sequence: Synthetic oligonucleotide
gggaggacgaugcggcacuuuguucuuuucucccgcagacgacucgcccga

SEQ ID NO: 13600 - RNA, 51 nt, Artificial Sequence
  Description of Artificial Sequence: Synthetic oligonucleotide
gggaggacgaugcggaucuuuagcuuuuuacaccgcagacgacucgcccga

SEQ ID NO: 13601 - RNA, 51 nt, Artificial Sequence
  Description of Artificial Sequence: Synthetic oligonucleotide
gggaggacgaugcggucauucacuuuuucuuuccccagacgacucgcccga

SEQ ID NO: 13602 - RNA, 53 nt, Artificial Sequence
  Description of Artificial Sequence: Synthetic oligonucleotide
gggaggacgaugcgguguuuuuuuuucccuuuccccgcagacgacucgcccga

SEQ ID NO: 13603 - RNA, 51 nt, Artificial Sequence
  Description of Artificial Sequence: Synthetic oligonucleotide
gggaggacgaugcgguuugggaguaggguguucagcagacgacucgcccga

SEQ ID NO: 13604 - RNA, 51 nt, Artificial Sequence
  Description of Artificial Sequence: Synthetic oligonucleotide
gggaggacgaugcggauucuucuauuuuuucaccgcagacgacucgcccga

SEQ ID NO: 13605 - RNA, 50 nt, Artificial Sequence
  Description of Artificial Sequence: Synthetic oligonucleotide
gggaggacgaugcggcuuuuauucacuuuuuccgcagacgacucgcccga

SEQ ID NO: 13606 - RNA, 51 nt, Artificial Sequence
  Description of Artificial Sequence: Synthetic oligonucleotide
gggaggacgaugcgguuuucuuuguuuuuacgcgccagacgacucgcccga

SEQ ID NO: 13607 - RNA, 51 nt, Artificial Sequence
  Description of Artificial Sequence: Synthetic oligonucleotide
gggaggacgaugcgggcuuuuuuacuuucuuaccgcagacgacucgcccga

SEQ ID NO: 13608 - RNA, 52 nt, Artificial Sequence
  Description of Artificial Sequence: Synthetic oligonucleotide
gggaggacgaugcggauuuaucuauuuuuuuugcugcagacgacucgcccga

SEQ ID NO: 13609 - RNA, 52 nt, Artificial Sequence
  Description of Artificial Sequence: Synthetic oligonucleotide
gggaggacgaugcggucucuuuauuuuuuucuuccgcagacgacucgcccga

SEQ ID NO: 13610 - RNA, 51 nt, Artificial Sequence
  Description of Artificial Sequence: Synthetic oligonucleotide
gggaggacgaugcggccuuauuuuuugccuucccgcagacgacucgcccga

SEQ ID NO: 13611 - RNA, 53 nt, Artificial Sequence
  Description of Artificial Sequence: Synthetic oligonucleotide
gggaggacgaugcgguuucucagcuuuuuuuuuuccgcagacgacucgcccga

SEQ ID NO: 13612 - RNA, 51 nt, Artificial Sequence
  Description of Artificial Sequence: Synthetic oligonucleotide
gggaggacgaugcggcuuuuggcuuauuuuucccgcagacgacucgcccga

SEQ ID NO: 13613 - RNA, 51 nt, Artificial Sequence
  Description of Artificial Sequence: Synthetic oligonucleotide
gggaggacgaugcgguuuuuuauaucgcguuuccgcagacgacucgcccga

SEQ ID NO: 13614 - RNA, 51 nt, Artificial Sequence
  Description of Artificial Sequence: Synthetic oligonucleotide
gggaggacgaugcgguuacuuuucuuuucuucccccagacgacucgcccga

SEQ ID NO: 13615 - RNA, 49 nt, Artificial Sequence
  Description of Artificial Sequence: Synthetic oligonucleotide
gggaggacgaugcgguuuucuaucuuuuguccgcagacgacucgcccga

SEQ ID NO: 13616 - RNA, 51 nt, Artificial Sequence
  Description of Artificial Sequence: Synthetic oligonucleotide
gggaggacgaugcggcuuuuuuuuuuuucccaccgcagacgacucgcccga

SEQ ID NO: 13617 - RNA, 51 nt, Artificial Sequence
  Description of Artificial Sequence: Synthetic oligonucleotide
gggaggacgaugcgguguucacucaauuuuuuccgcagacgacucgcccga

SEQ ID NO: 13618 - RNA, 51 nt, Artificial Sequence
  Description of Artificial Sequence: Synthetic oligonucleotide
gggaggacgaugcgguuuauuuuuuucucgucccgcagacgacucgcccga

SEQ ID NO: 13619 - RNA, 51 nt, Artificial Sequence
  Description of Artificial Sequence: Synthetic oligonucleotide
gggaggacgaugcggcuuuuuguuuuacuuuugugcagacgacucgcccga

SEQ ID NO: 13620 - RNA, 51 nt, Artificial Sequence
  Description of Artificial Sequence: Synthetic oligonucleotide
gggaggacgaugcggcuuucuuuuccacuuuuccgcagacgacucgcccga

SEQ ID NO: 13621 - RNA, 52 nt, Artificial Sequence
  Description of Artificial Sequence: Synthetic oligonucleotide
gggaggacgaugcggccauuuguucuuuuucuuccgcagacgacucgcccga

SEQ ID NO: 13622 - RNA, 51 nt, Artificial Sequence
  Description of Artificial Sequence: Synthetic oligonucleotide
gggaggacgaugcggcuucacuuuuuuucucuccgcagacgacucgcccga

SEQ ID NO: 13623 - RNA, 52 nt, Artificial Sequence
  Description of Artificial Sequence: Synthetic oligonucleotide
gggaggacgaugcggauuuuugguauuuuuuuaccgcagacgacucgcccga

SEQ ID NO: 13624 - RNA, 51 nt, Artificial Sequence
  Description of Artificial Sequence: Synthetic oligonucleotide
gggaggacgaugcgguuuacucguuauuuuugccgcagacgacucgcccga

SEQ ID NO: 13625 - RNA, 52 nt, Artificial Sequence
  Description of Artificial Sequence: Synthetic oligonucleotide
gggaggacgaugcggaucuugcugcuuuuuuuaccgcagacgacucgcccga

SEQ ID NO: 13626 - RNA, 51 nt, Artificial Sequence
  Description of Artificial Sequence: Synthetic oligonucleotide
gggaggacgaugcggauuugcuccuuuuuuucccgcagacgacucgcccga

SEQ ID NO: 13627 - RNA, 50 nt, Artificial Sequence
  Description of Artificial Sequence: Synthetic oligonucleotide
gggaggacgaugcggaguuuuuuuauuuguugcccagacgacucgcccga

SEQ ID NO: 13628 - RNA, 50 nt, Artificial Sequence
  Description of Artificial Sequence: Synthetic oligonucleotide
gggaggacgaugcggguugguguagggggguccgcagacgacucgcccga

SEQ ID NO: 13629 - RNA, 51 nt, Artificial Sequence
  Description of Artificial Sequence: Synthetic oligonucleotide
gggaggacgaugcgguucgaagggcgguggguccgcagacgacucgcccga

SEQ ID NO: 13630 - RNA, 50 nt, Artificial Sequence
  Description of Artificial Sequence: Synthetic oligonucleotide
gggaggacgaugcgguuugaagggugauguuccgcagacgacucgcccga

SEQ ID NO: 13631 - RNA, 52 nt, Artificial Sequence
  Description of Artificial Sequence: Synthetic oligonucleotide
gggaggacgaugcggcauaggaguagggugguaccgcagacgacucgcccga

SEQ ID NO: 13632 - RNA, 50 nt, Artificial Sequence
  Description of Artificial Sequence: Synthetic oligonucleotide
gggaggacgaugcgguccuugucgucuucguccccagacgacucgcccga

SEQ ID NO: 13633 - RNA, 51 nt, Artificial Sequence
  Description of Artificial Sequence: Synthetic oligonucleotide
gggaggacgaugcgguucuugucgucuugcguccccagacgacucgcccga

SEQ ID NO: 13634 - RNA, 51 nt, Artificial Sequence
  Description of Artificial Sequence: Synthetic oligonucleotide
gggaggacgaugcggaaccuccucagucguguggccagacgacucgcccga

SEQ ID NO: 13635 - RNA, 51 nt, Artificial Sequence
  Description of Artificial Sequence: Synthetic oligonucleotide
gggaggacgaugcgguccugucgucuguucucccccagacgacucgcccga

SEQ ID NO: 13636 - RNA, 50 nt, Artificial Sequence
  Description of Artificial Sequence: Synthetic oligonucleotide
gggaggacgaugcgguccuuucguucugcccccccagacgacucgcccga

SEQ ID NO: 13637 - RNA, 52 nt, Artificial Sequence
  Description of Artificial Sequence: Synthetic oligonucleotide
gggaggacgaugcggucugcugugcuugauaugccccagacgacucgcccga

SEQ ID NO: 13638 - RNA, 51 nt, Artificial Sequence
  Description of Artificial Sequence: Synthetic oligonucleotide
gggaggacgaugcggacuuuuuucucucuuuuccgcagacgacucgcccga

SEQ ID NO: 13639 - RNA, 51 nt, Artificial Sequence
  Description of Artificial Sequence: Synthetic oligonucleotide
gggaggacgaugcggauccuuuacuuucuuugccccagacgacucgcccga

SEQ ID NO: 13640 - RNA, 51 nt, Artificial Sequence
  Description of Artificial Sequence: Synthetic oligonucleotide
gggaggacgaugcgguucuucuucuauucucaccgcagacgacucgcccga

SEQ ID NO: 13641 - RNA, 51 nt, Artificial Sequence
  Description of Artificial Sequence: Synthetic oligonucleotide
gggaggacgaugcggauuuucucuuauucuugccccagacgacucgcccga

SEQ ID NO: 13642 - RNA, 51 nt, Artificial Sequence
  Description of Artificial Sequence: Synthetic oligonucleotide
gggaggacgaugcgguuuuucccuuuccucugccgcagacgacucgcccga

SEQ ID NO: 13643 - RNA, 51 nt, Artificial Sequence
  Description of Artificial Sequence: Synthetic oligonucleotide
gggaggacgaugcgggauuucucuugccuuugccccagacgacucgcccga

SEQ ID NO: 13644 - RNA, 53 nt, Artificial Sequence
  Description of Artificial Sequence: Synthetic oligonucleotide
gggaggacgaugcggcuuuucucuuuuuuuuccgcgccagacgacucgcccga

SEQ ID NO: 13645 - RNA, 51 nt, Artificial Sequence
  Description of Artificial Sequence: Synthetic oligonucleotide
gggaggacgaugcgggccucucguucuucccuccccagacgacucgcccga

SEQ ID NO: 13646 - RNA, 51 nt, Artificial Sequence
  Description of Artificial Sequence: Synthetic oligonucleotide
gggaggacgaugcgguucuucuuuuccuuuguccgcagacgacucgcccga

SEQ ID NO: 13647 - RNA, 52 nt, Artificial Sequence
  Description of Artificial Sequence: Synthetic oligonucleotide
gggaggacgaugcggucuauuugguacuuuuuuccgcagacgacucgcccga

SEQ ID NO: 13648 - RNA, 51 nt, Artificial Sequence
  Description of Artificial Sequence: Synthetic oligonucleotide
gggaggacgaugcggccacacuuuuccucuuuccgcagacgacucgcccga

SEQ ID NO: 13649 - RNA, 51 nt, Artificial Sequence
  Description of Artificial Sequence: Synthetic oligonucleotide
gggaggacgaugcggccuuacauauuccucuuccgcagacgacucgcccga

SEQ ID NO: 13650 - RNA, 51 nt, Artificial Sequence
  Description of Artificial Sequence: Synthetic oligonucleotide
gggaggacgaugcggucucuauguucgcuucuccgcagacgacucgcccga

SEQ ID NO: 13651 - RNA, 51 nt, Artificial Sequence
  Description of Artificial Sequence: Synthetic oligonucleotide
gggaggacgaugcggguuuauggaggagguuggugcagacgacucgcccga

SEQ ID NO: 13652 - RNA, 49 nt, Artificial Sequence
  Description of Artificial Sequence: Synthetic oligonucleotide
gggaggacgaugcggccuuuuacuuuuucuccgcagacgacucgcccga

SEQ ID NO: 13653 - RNA, 51 nt, Artificial Sequence
  Description of Artificial Sequence: Synthetic oligonucleotide
gggaggacgaugcggccuuuguuccuguauuuccgcagacgacucgcccga

SEQ ID NO: 13654 - RNA, 53 nt, Artificial Sequence
  Description of Artificial Sequence: Synthetic oligonucleotide
gggaggacgaugcggacuuuuuuuuugucuucugccgcagacgacucgcccga

SEQ ID NO: 13655 - RNA, 53 nt, Artificial Sequence
  Description of Artificial Sequence: Synthetic oligonucleotide
gggaggacgaugcggccuuuguauuuuuuuucauccgcagacgacucgcccga

SEQ ID NO: 13656 - RNA, 51 nt, Artificial Sequence
  Description of Artificial Sequence: Synthetic oligonucleotide
gggaggacgaugcggaucucguuucacuuucaccgcagacgacucgcccga

SEQ ID NO: 13657 - RNA, 51 nt, Artificial Sequence
  Description of Artificial Sequence: Synthetic oligonucleotide
gggaggacgaugcgguuuauucgguauuuucuccgcagacgacucgcccga

SEQ ID NO: 13658 - RNA, 51 nt, Artificial Sequence
  Description of Artificial Sequence: Synthetic oligonucleotide
gggaggacgaugcgguauuuuccauucaccuuccgcagacgacucgcccga

SEQ ID NO: 13659 - RNA, 51 nt, Artificial Sequence
  Description of Artificial Sequence: Synthetic oligonucleotide
gggaggacgaugcgggucucacuuuuuuaucuccgcagacgacucgcccga

SEQ ID NO: 13660 - RNA, 52 nt, Artificial Sequence
  Description of Artificial Sequence: Synthetic oligonucleotide
gggaggacgaugcgguuguuuuuuuauugugucccgcagacgacucgcccga

SEQ ID NO: 13661 - RNA, 51 nt, Artificial Sequence
  Description of Artificial Sequence: Synthetic oligonucleotide
gggaggacgaugcgguuuuagcuuuuuuuuguccgcagacgacucgcccga

SEQ ID NO: 13662 - RNA, 52 nt, Artificial Sequence
  Description of Artificial Sequence: Synthetic oligonucleotide
gggaggacgaugcggaguaucuaucuuuuuuugccgcagacgacucgcccga

SEQ ID NO: 13663 - RNA, 50 nt, Artificial Sequence
  Description of Artificial Sequence: Synthetic oligonucleotide
gggaggacgaugcggcuuuuuuucaugcuuuccgcagacgacucgcccga

SEQ ID NO: 13664 - RNA, 53 nt, Artificial Sequence
  Description of Artificial Sequence: Synthetic oligonucleotide
gggaggacgaugcggucuuuuuuucauuaucuccccgcagacgacucgcccga

SEQ ID NO: 13665 - RNA, 51 nt, Artificial Sequence
  Description of Artificial Sequence: Synthetic oligonucleotide
gggaggacgaugcgggcuuucugucccuuuuuccgcagacgacucgcccga

SEQ ID NO: 13666 - RNA, 51 nt, Artificial Sequence
  Description of Artificial Sequence: Synthetic oligonucleotide
gggaggacgaugcggucuucguuuccuuuucaccgcagacgacucgcccga

SEQ ID NO: 13667 - RNA, 51 nt, Artificial Sequence
  Description of Artificial Sequence: Synthetic oligonucleotide
gggaggacgaugcggaucuuuuuuucucaccuccgcagacgacucgcccga

SEQ ID NO: 13668 - RNA, 51 nt, Artificial Sequence
  Description of Artificial Sequence: Synthetic oligonucleotide
gggaggacgaugcgguuuuuuguguuucuugcccccagacgacucgcccga

SEQ ID NO: 13669 - RNA, 51 nt, Artificial Sequence
  Description of Artificial Sequence: Synthetic oligonucleotide
gggaggacgaugcgguuuuuuuugucuuucuuccgcagacgacucgcccga

SEQ ID NO: 13670 - RNA, 51 nt, Artificial Sequence
  Description of Artificial Sequence: Synthetic oligonucleotide
gggaggacgaugcgguuugcccuuaucuuuuuccgcagacgacucgcccga

SEQ ID NO: 13671 - RNA, 51 nt, Artificial Sequence
  Description of Artificial Sequence: Synthetic oligonucleotide
gggaggacgaugcgguuuuguucucuuuucuuccgcagacgacucgcccga

SEQ ID NO: 13672 - RNA, 49 nt, Artificial Sequence
  Description of Artificial Sequence: Synthetic oligonucleotide
gggaggacgaugcgguucguacuuuuuuuuccgcagacgacucgcccga

SEQ ID NO: 13673 - RNA, 51 nt, Artificial Sequence
  Description of Artificial Sequence: Synthetic oligonucleotide
gggaggacgaugcggcuuuuuaaacucucacuccgcagacgacucgcccga

SEQ ID NO: 13674 - RNA, 51 nt, Artificial Sequence
  Description of Artificial Sequence: Synthetic oligonucleotide
gggaggacgaugcggccuuuuacuuuuuuccuccgcagacgacucgcccga

SEQ ID NO: 13675 - RNA, 51 nt, Artificial Sequence
  Description of Artificial Sequence: Synthetic oligonucleotide
gggaggacgaugcgggucuuuacuguuucuccccgcagacgacucgcccga

SEQ ID NO: 13676 - RNA, 51 nt, Artificial Sequence
  Description of Artificial Sequence: Synthetic oligonucleotide
gggaggacgaugcgguccauuuucuuuucucuccgcagacgacucgcccga

SEQ ID NO: 13677 - RNA, 51 nt, Artificial Sequence
  Description of Artificial Sequence: Synthetic oligonucleotide
gggaggacgaugcggccuuguuuguuuuuuucccgcagacgacucgcccga

SEQ ID NO: 13678 - RNA, 51 nt, Artificial Sequence
  Description of Artificial Sequence: Synthetic oligonucleotide
gggaggacgaugcggccuuuacuuuuuauucccgccagacgacucgcccga

SEQ ID NO: 13679 - RNA, 51 nt, Artificial Sequence
  Description of Artificial Sequence: Synthetic oligonucleotide
gggaggacgaugcgguuucuugauuuuuuccucggcagacgacucgcccga

SEQ ID NO: 13680 - RNA, 51 nt, Artificial Sequence
  Description of Artificial Sequence: Synthetic oligonucleotide
gggaggacgaugcggcuuucucuugucuuauaccgcagacgacucgcccga

SEQ ID NO: 13681 - RNA, 51 nt, Artificial Sequence
  Description of Artificial Sequence: Synthetic oligonucleotide
gggaggacgaugcggacuuauuuguuuucuuccugcagacgacucgcccga

SEQ ID NO: 13682 - RNA, 53 nt, Artificial Sequence
  Description of Artificial Sequence: Synthetic oligonucleotide
gggaggacgaugcgguuacuuucuaauuuuccggccgcagacgacucgcccga

SEQ ID NO: 13683 - RNA, 51 nt, Artificial Sequence
  Description of Artificial Sequence: Synthetic oligonucleotide
gggaggacgaugcgguucuuucuauauuuuuuccgcagacgacucgcccga

SEQ ID NO: 13684 - RNA, 51 nt, Artificial Sequence
  Description of Artificial Sequence: Synthetic oligonucleotide
gggaggacgaugcggacuuuuuauucauuucccugcagacgacucgcccga

SEQ ID NO: 13685 - RNA, 51 nt, Artificial Sequence
  Description of Artificial Sequence: Synthetic oligonucleotide
gggaggacgaugcggacuuuauacuuguuuccccgcagacgacucgcccga

SEQ ID NO: 13686 - RNA, 51 nt, Artificial Sequence
  Description of Artificial Sequence: Synthetic oligonucleotide
gggaggacgaugcggucuuuuuaucuucauucccgcagacgacucgcccga

SEQ ID NO: 13687 - RNA, 51 nt, Artificial Sequence
  Description of Artificial Sequence: Synthetic oligonucleotide
gggaggacgaugcggauuaucuuucacuuuuuccgcagacgacucgcccga

SEQ ID NO: 13688 - RNA, 51 nt, Artificial Sequence
  Description of Artificial Sequence: Synthetic oligonucleotide
gggaggacgaugcggcuuugucuuaauuucuaccgcagacgacucgcccga

SEQ ID NO: 13689 - RNA, 51 nt, Artificial Sequence
  Description of Artificial Sequence: Synthetic oligonucleotide
gggaggacgaugcgguauucauuucucuuuuacgccagacgacucgcccga

SEQ ID NO: 13690 - RNA, 51 nt, Artificial Sequence
  Description of Artificial Sequence: Synthetic oligonucleotide
gggaggacgaugcggcucuauacaauuucuuuccgcagacgacucgcccga

SEQ ID NO: 13691 - RNA, 51 nt, Artificial Sequence
  Description of Artificial Sequence: Synthetic oligonucleotide
gggaggacgaugcgguuacuuuaauucuuuuugugcagacgacucgcccga

SEQ ID NO: 13692 - RNA, 51 nt, Artificial Sequence
  Description of Artificial Sequence: Synthetic oligonucleotide
gggaggacgaugcgguuuuuaauuuuucguucccgcagacgacucgcccga

SEQ ID NO: 13693 - RNA, 51 nt, Artificial Sequence
  Description of Artificial Sequence: Synthetic oligonucleotide
gggaggacgaugcgguuuucucucuuuucucaccccagacgacucgcccga

SEQ ID NO: 13694 - RNA, 51 nt, Artificial Sequence
  Description of Artificial Sequence: Synthetic oligonucleotide
gggaggacgaugcggucauuucuuuuuucccagugcagacgacucgcccga

SEQ ID NO: 13695 - RNA, 52 nt, Artificial Sequence
  Description of Artificial Sequence: Synthetic oligonucleotide
gggaggacgaugcggucuuauucuuuuuuuccucugcagacgacucgcccga

SEQ ID NO: 13696 - RNA, 51 nt, Artificial Sequence
  Description of Artificial Sequence: Synthetic oligonucleotide
gggaggacgaugcgguaucuucuuuuccuucgcugcagacgacucgcccga

SEQ ID NO: 13697 - RNA, 51 nt, Artificial Sequence
  Description of Artificial Sequence: Synthetic oligonucleotide
gggaggacgaugcgguuguuuuuuauucuauuccgcagacgacucgcccga

SEQ ID NO: 13698 - RNA, 51 nt, Artificial Sequence
  Description of Artificial Sequence: Synthetic oligonucleotide
gggaggacgaugcggcauuuuauccuguucauccgcagacgacucgcccga

SEQ ID NO: 13699 - RNA, 51 nt, Artificial Sequence
  Description of Artificial Sequence: Synthetic oligonucleotide
gggaggacgaugcgguauauuccuuguuuucucugcagacgacucgcccga

SEQ ID NO: 13700 - RNA, 52 nt, Artificial Sequence
  Description of Artificial Sequence: Synthetic oligonucleotide
gggaggacgaugcggauuuaucaauucuuucuaccccagacgacucgcccga

SEQ ID NO: 13701 - RNA, 51 nt, Artificial Sequence
  Description of Artificial Sequence: Synthetic oligonucleotide
gggaggacgaugcggcuucugucucuuauuuuccgcagacgacucgcccga

SEQ ID NO: 13702 - RNA, 51 nt, Artificial Sequence
  Description of Artificial Sequence: Synthetic oligonucleotide
gggaggacgaugcgguaucuuuucuccuuuggccgcagacgacucgcccga

SEQ ID NO: 13703 - RNA, 52 nt, Artificial Sequence
  Description of Artificial Sequence: Synthetic oligonucleotide
gggaggacgaugcgguuuuucuauccuuuuccacugcagacgacucgcccga

SEQ ID NO: 13704 - RNA, 51 nt, Artificial Sequence
  Description of Artificial Sequence: Synthetic oligonucleotide
gggaggacgaugcggacuuacuguuuacuuuaccgcagacgacucgcccga

SEQ ID NO: 13705 - RNA, 51 nt, Artificial Sequence
  Description of Artificial Sequence: Synthetic oligonucleotide
gggaggacgaugcggcacuuuuuuucuuuaucccccagacgacucgcccga

SEQ ID NO: 13706 - RNA, 51 nt, Artificial Sequence
  Description of Artificial Sequence: Synthetic oligonucleotide
gggaggacgaugcgguuaucacuuucuuuuuacgccagacgacucgcccga

SEQ ID NO: 13707 - RNA, 51 nt, Artificial Sequence
  Description of Artificial Sequence: Synthetic oligonucleotide
gggaggacgaugcggucuuuucuuuuuuagcuccccagacgacucgcccga

SEQ ID NO: 13708 - RNA, 51 nt, Artificial Sequence
  Description of Artificial Sequence: Synthetic oligonucleotide
gggaggacgaugcgguuucuauuugucuucaugugcagacgacucgcccga

SEQ ID NO: 13709 - RNA, 51 nt, Artificial Sequence
  Description of Artificial Sequence: Synthetic oligonucleotide
gggaggacgaugcggaacuuuuuccuuuauuuccgcagacgacucgcccga

SEQ ID NO: 13710 - RNA, 52 nt, Artificial Sequence
  Description of Artificial Sequence: Synthetic oligonucleotide
gggaggacgaugcgguauugugaucuuuuuuuuccgcagacgacucgcccga

SEQ ID NO: 13711 - RNA, 53 nt, Artificial Sequence
  Description of Artificial Sequence: Synthetic oligonucleotide
gggaggacgaugcgguuuuagcuuuuuuuuuuguccgcagacgacucgcccga

SEQ ID NO: 13712 - RNA, 52 nt, Artificial Sequence
  Description of Artificial Sequence: Synthetic oligonucleotide
gggaggacgaugcggauuacuugguuuuuuucaccgcagacgacucgcccga

SEQ ID NO: 13713 - RNA, 51 nt, Artificial Sequence
  Description of Artificial Sequence: Synthetic oligonucleotide
gggaggacgaugcgguucuuaauuacucucucccgcagacgacucgcccga

SEQ ID NO: 13714 - RNA, 51 nt, Artificial Sequence
  Description of Artificial Sequence: Synthetic oligonucleotide
gggaggacgaugcggcauucuuuucgcuuuuuccgcagacgacucgcccga

SEQ ID NO: 13715 - RNA, 51 nt, Artificial Sequence
  Description of Artificial Sequence: Synthetic oligonucleotide
gggaggacgaugcggaccauuauuuuucuauuccccagacgacucgcccga

SEQ ID NO: 13716 - RNA, 52 nt, Artificial Sequence
  Description of Artificial Sequence: Synthetic oligonucleotide
gggaggacgaugcggacuuuuugcuguuuuuuuccccagacgacucgcccga

SEQ ID NO: 13717 - RNA, 51 nt, Artificial Sequence
  Description of Artificial Sequence: Synthetic oligonucleotide
gggaggacgaugcgguuuacuauuuauucugucugcagacgacucgcccga

SEQ ID NO: 13718 - RNA, 51 nt, Artificial Sequence
  Description of Artificial Sequence: Synthetic oligonucleotide
gggaggacgaugcgggucuuuaaaucucuuuuccccagacgacucgcccga

SEQ ID NO: 13719 - RNA, 50 nt, Artificial Sequence
  Description of Artificial Sequence: Synthetic oligonucleotide
gggaggacgaugcggacuuuacucuucuuuaccgcagacgacucgcccga

SEQ ID NO: 13720 - RNA, 51 nt, Artificial Sequence
  Description of Artificial Sequence: Synthetic oligonucleotide
gggaggacgaugcgguuucuacacaaccuuuuccgcagacgacucgcccga

SEQ ID NO: 13721 - RNA, 50 nt, Artificial Sequence
  Description of Artificial Sequence: Synthetic oligonucleotide
gggaggacgaugcggucacuuuuaucucuuucugcagacgacucgcccga

SEQ ID NO: 13722 - RNA, 53 nt, Artificial Sequence
  Description of Artificial Sequence: Synthetic oligonucleotide
gggaggacgaugcggauuuuccuuuuuuuuuucccgccagacgacucgcccga

SEQ ID NO: 13723 - RNA, 51 nt, Artificial Sequence
  Description of Artificial Sequence: Synthetic oligonucleotide
gggaggacgaugcgguacuuauuucuuacucucugcagacgacucgcccga

SEQ ID NO: 13724 - RNA, 52 nt, Artificial Sequence
  Description of Artificial Sequence: Synthetic oligonucleotide
gggaggacgaugcgguuuuuucucuuuuuuccgccgcagacgacucgcccga

SEQ ID NO: 13725 - RNA, 51 nt, Artificial Sequence
  Description of Artificial Sequence: Synthetic oligonucleotide
gggaggacgaugcggccguuauucuaguuuuuccgcagacgacucgcccga

SEQ ID NO: 13726 - RNA, 50 nt, Artificial Sequence
  Description of Artificial Sequence: Synthetic oligonucleotide
gggaggacgaugcgguuucuugucauuuuuuccgcagacgacucgcccga

SEQ ID NO: 13727 - RNA, 51 nt, Artificial Sequence
  Description of Artificial Sequence: Synthetic oligonucleotide
gggaggacgaugcggaguuuuucacuuauuuuccgcagacgacucgcccga

SEQ ID NO: 13728 - RNA, 51 nt, Artificial Sequence
  Description of Artificial Sequence: Synthetic oligonucleotide
gggaggacgaugcgguuucaauuucccucuuuccgcagacgacucgcccga

SEQ ID NO: 13729 - RNA, 51 nt, Artificial Sequence
  Description of Artificial Sequence: Synthetic oligonucleotide
gggaggacgaugcggcuucauaaucuuucuuuccgcagacgacucgcccga

SEQ ID NO: 13730 - RNA, 51 nt, Artificial Sequence
  Description of Artificial Sequence: Synthetic oligonucleotide
gggaggacgaugcggguuuugcuccuuuuucaccgcagacgacucgcccga

SEQ ID NO: 13731 - RNA, 51 nt, Artificial Sequence
  Description of Artificial Sequence: Synthetic oligonucleotide
gggaggacgaugcgguaucuuuaucccuauuuccgcagacgacucgcccga

SEQ ID NO: 13732 - RNA, 51 nt, Artificial Sequence
  Description of Artificial Sequence: Synthetic oligonucleotide
gggaggacgaugcgguuuuccuuaauccuuucccgcagacgacucgcccga

SEQ ID NO: 13733 - RNA, 51 nt, Artificial Sequence
  Description of Artificial Sequence: Synthetic oligonucleotide
gggaggacgaugcgguuacuuucucuuuucuuguccagacgacucgcccga

SEQ ID NO: 13734 - RNA, 51 nt, Artificial Sequence
  Description of Artificial Sequence: Synthetic oligonucleotide
gggaggacgaugcgguauucauuucuaucuuuccccagacgacucgcccga

SEQ ID NO: 13735 - RNA, 49 nt, Artificial Sequence
  Description of Artificial Sequence: Synthetic oligonucleotide
gggaggacgaugcgguuuugcuuuuuuuucccccagacgacucgcccga

SEQ ID NO: 13736 - RNA, 51 nt, Artificial Sequence
  Description of Artificial Sequence: Synthetic oligonucleotide
gggaggacgaugcggauacuuuaacucucuucccgcagacgacucgcccga

SEQ ID NO: 13737 - RNA, 51 nt, Artificial Sequence
  Description of Artificial Sequence: Synthetic oligonucleotide
gggaggacgaugcggucuguuuguucuuuucuucccagacgacucgcccga

SEQ ID NO: 13738 - RNA, 51 nt, Artificial Sequence
  Description of Artificial Sequence: Synthetic oligonucleotide
gggaggacgaugcgggucuuucuuuuugccuuccgcagacgacucgcccga

SEQ ID NO: 13739 - RNA, 52 nt, Artificial Sequence
  Description of Artificial Sequence: Synthetic oligonucleotide
gggaggacgaugcgguuuuaucuuucuuuuuuuccccagacgacucgcccga

SEQ ID NO: 13740 - RNA, 52 nt, Artificial Sequence
  Description of Artificial Sequence: Synthetic oligonucleotide
gggaggacgaugcggguuuuuuuuucuccuuucccgcagacgacucgcccga

SEQ ID NO: 13741 - RNA, 53 nt, Artificial Sequence
  Description of Artificial Sequence: Synthetic oligonucleotide
gggaggacgaugcgguuucuuuuuuuucaacuccccgcagacgacucgcccga

SEQ ID NO: 13742 - RNA, 50 nt, Artificial Sequence
  Description of Artificial Sequence: Synthetic oligonucleotide
gggaggacgaugcggcuuuucuucucuuuuuccgcagacgacucgcccga

SEQ ID NO: 13743 - RNA, 53 nt, Artificial Sequence
  Description of Artificial Sequence: Synthetic oligonucleotide
gggaggacgaugcggaucuuuauuuuuuuucucuccgcagacgacucgcccga

SEQ ID NO: 13744 - RNA, 52 nt, Artificial Sequence
  Description of Artificial Sequence: Synthetic oligonucleotide
gggaggacgaugcgguguuuuuuuaugcuuuugccgcagacgacucgcccga

SEQ ID NO: 13745 - RNA, 51 nt, Artificial Sequence
  Description of Artificial Sequence: Synthetic oligonucleotide
gggaggacgaugcggguuuucauuauuucuuugcccagacgacucgcccga

SEQ ID NO: 13746 - RNA, 50 nt, Artificial Sequence
  Description of Artificial Sequence: Synthetic oligonucleotide
gggaggacgaugcgguuuuuccuuauucuuuccgcagacgacucgcccga

SEQ ID NO: 13747 - RNA, 51 nt, Artificial Sequence
  Description of Artificial Sequence: Synthetic oligonucleotide
gggaggacgaugcgguuucuguuuuauuucgcccccagacgacucgcccga

SEQ ID NO: 13748 - RNA, 53 nt, Artificial Sequence
  Description of Artificial Sequence: Synthetic oligonucleotide
gggaggacgaugcggauaguuuuguuuuuuuucgccgcagacgacucgcccga

SEQ ID NO: 13749 - RNA, 52 nt, Artificial Sequence
  Description of Artificial Sequence: Synthetic oligonucleotide
gggaggacgaugcgguuuugccuuaauuuguuuccgcagacgacucgcccga

SEQ ID NO: 13750 - RNA, 50 nt, Artificial Sequence
  Description of Artificial Sequence: Synthetic oligonucleotide
gggaggacgaugcgguuuguuuauuuuuuguccccagacgacucgcccga

SEQ ID NO: 13751 - RNA, 51 nt, Artificial Sequence
  Description of Artificial Sequence: Synthetic oligonucleotide
gggaggacgaugcggcuucuuucuuucuuuuuccccagacgacucgcccga

SEQ ID NO: 13752 - RNA, 51 nt, Artificial Sequence
  Description of Artificial Sequence: Synthetic oligonucleotide
gggaggacgaugcgguuauuguuuuauuuuuugcccagacgacucgcccga

SEQ ID NO: 13753 - RNA, 52 nt, Artificial Sequence
  Description of Artificial Sequence: Synthetic oligonucleotide
gggaggacgaugcggccuuuuacuuuuuuuccuccgcagacgacucgcccga

SEQ ID NO: 13754 - RNA, 52 nt, Artificial Sequence
  Description of Artificial Sequence: Synthetic oligonucleotide
gggaggacgaugcgguuauuuuuuuacuuccugcugcagacgacucgcccga

SEQ ID NO: 13755 - RNA, 53 nt, Artificial Sequence
  Description of Artificial Sequence: Synthetic oligonucleotide
gggaggacgaugcggcauuguuuuauuuuuuccccgccagacgacucgcccga

SEQ ID NO: 13756 - RNA, 52 nt, Artificial Sequence
  Description of Artificial Sequence: Synthetic oligonucleotide
gggaggacgaugcggguccugucguuuguucguccccagacgacucgcccga

SEQ ID NO: 13757 - RNA, 51 nt, Artificial Sequence
  Description of Artificial Sequence: Synthetic oligonucleotide
gggaggacgaugcgguuugaagggugaugggaccccagacgacucgcccga

SEQ ID NO: 13758 - RNA, 51 nt, Artificial Sequence
  Description of Artificial Sequence: Synthetic oligonucleotide
gggaggacgaugcggcuuauggaguaggguggcgccagacgacucgcccga

SEQ ID NO: 13759 - RNA, 51 nt, Artificial Sequence
  Description of Artificial Sequence: Synthetic oligonucleotide
gggaggacgaugcggcuuucacuuuuuucccuccgcagacgacucgcccga

SEQ ID NO: 13760 - RNA, 52 nt, Artificial Sequence
  Description of Artificial Sequence: Synthetic oligonucleotide
gggaggacgaugcgguuuuacuacuuuuuuugcccgcagacgacucgcccga

SEQ ID NO: 13761 - RNA, 51 nt, Artificial Sequence
  Description of Artificial Sequence: Synthetic oligonucleotide
gggaggacgaugcggauuuucuccuuuuucugccgcagacgacucgcccga

SEQ ID NO: 13762 - RNA, 52 nt, Artificial Sequence
  Description of Artificial Sequence: Synthetic oligonucleotide
gggaggacgaugcgguuuuauauucugcccgcuccgcagacgacucgcccga

SEQ ID NO: 13763 - RNA, 51 nt, Artificial Sequence
  Description of Artificial Sequence: Synthetic oligonucleotide
gggaggacgaugcggguuauugcuccuuuuugccgcagacgacucgcccga

SEQ ID NO: 13764 - RNA, 51 nt, Artificial Sequence
  Description of Artificial Sequence: Synthetic oligonucleotide
gggaggacgaugcggauucauuucuuuucuugccgcagacgacucgcccga

SEQ ID NO: 13765 - RNA, 51 nt, Artificial Sequence
  Description of Artificial Sequence: Synthetic oligonucleotide
gggaggacgaugcgguuucucucuugcucguuccgcagacgacucgcccga

SEQ ID NO: 13766 - RNA, 51 nt, Artificial Sequence
  Description of Artificial Sequence: Synthetic oligonucleotide
gggaggacgaugcggucuuucacugucuuuugccgcagacgacucgcccga

SEQ ID NO: 13767 - RNA, 50 nt, Artificial Sequence
  Description of Artificial Sequence: Synthetic oligonucleotide
gggaggacgaugcggaccuuuucuuccuauuccgcagacgacucgcccga

SEQ ID NO: 13768 - RNA, 51 nt, Artificial Sequence
  Description of Artificial Sequence: Synthetic oligonucleotide
gggaggacgaugcggaucguuuacuguuuuugccgcagacgacucgcccga

SEQ ID NO: 13769 - RNA, 51 nt, Artificial Sequence
  Description of Artificial Sequence: Synthetic oligonucleotide
gggaggacgaugcggcuuauuuuacucuuucugcccagacgacucgcccga

SEQ ID NO: 13770 - RNA, 51 nt, Artificial Sequence
  Description of Artificial Sequence: Synthetic oligonucleotide
gggaggacgaugcggaugcuuggagcagggaggugcagacgacucgcccga

SEQ ID NO: 13771 - RNA, 51 nt, Artificial Sequence
  Description of Artificial Sequence: Synthetic oligonucleotide
gggaggacgaugcgguuuggggguaggggguuccgcagacgacucgcccga

SEQ ID NO: 13772 - RNA, 51 nt, Artificial Sequence
  Description of Artificial Sequence: Synthetic oligonucleotide
gggaggacgaugcggcguuucauuuuucccuugcccagacgacucgcccga

SEQ ID NO: 13773 - RNA, 52 nt, Artificial Sequence
  Description of Artificial Sequence: Synthetic oligonucleotide
gggaggacgaugcgguuuuccagguuuuuuucccgccagacgacucgcccga

SEQ ID NO: 13774 - RNA, 51 nt, Artificial Sequence
  Description of Artificial Sequence: Synthetic oligonucleotide
gggaggacgaugcggauuauuccucuuuuuguccgcagacgacucgcccga

SEQ ID NO: 13775 - RNA, 51 nt, Artificial Sequence
  Description of Artificial Sequence: Synthetic oligonucleotide
gggaggacgaugcgguuuccuguauuucucauccgcagacgacucgcccga

SEQ ID NO: 13776 - RNA, 51 nt, Artificial Sequence
  Description of Artificial Sequence: Synthetic oligonucleotide
gggaggacgaugcgguuuuuaguuuguuuucccgccagacgacucgcccga

SEQ ID NO: 13777 - RNA, 53 nt, Artificial Sequence
  Description of Artificial Sequence: Synthetic oligonucleotide
gggaggacgaugcggauucuugcuuuuuuuuuugccgcagacgacucgcccga

SEQ ID NO: 13778 - RNA, 51 nt, Artificial Sequence
  Description of Artificial Sequence: Synthetic oligonucleotide
gggaggacgaugcggccuuuaucucuuugccuccgcagacgacucgcccga

SEQ ID NO: 13779 - RNA, 50 nt, Artificial Sequence
  Description of Artificial Sequence: Synthetic oligonucleotide
gggaggacgaugcgguuuggaguaggguguuccgcagacgacucgcccga

SEQ ID NO: 13780 - RNA, 51 nt, Artificial Sequence
  Description of Artificial Sequence: Synthetic oligonucleotide
gggaggacgaugcggacuuacuuauuucccuuccgcagacgacucgcccga

SEQ ID NO: 13781 - RNA, 51 nt, Artificial Sequence
  Description of Artificial Sequence: Synthetic oligonucleotide
gggaggacgaugcggcuuuuuccaucuuauuaccgcagacgacucgcccga

SEQ ID NO: 13782 - RNA, 51 nt, Artificial Sequence
  Description of Artificial Sequence: Synthetic oligonucleotide
gggaggacgaugcggucuuuuacugcuuauuuccgcagacgacucgcccga

SEQ ID NO: 13783 - RNA, 51 nt, Artificial Sequence
  Description of Artificial Sequence: Synthetic oligonucleotide
gggaggacgaugcggucuuuauuccucugcuuccgcagacgacucgcccga

SEQ ID NO: 13784 - RNA, 51 nt, Artificial Sequence
  Description of Artificial Sequence: Synthetic oligonucleotide
gggaggacgaugcggaucuucgucuauuuuuuccgcagacgacucgcccga

SEQ ID NO: 13785 - RNA, 51 nt, Artificial Sequence
  Description of Artificial Sequence: Synthetic oligonucleotide
gggaggacgaugcggcauuaccugucuuuucuccgcagacgacucgcccga

SEQ ID NO: 13786 - RNA, 49 nt, Artificial Sequence
  Description of Artificial Sequence: Synthetic oligonucleotide
gggaggacgaugcggacuuucuucucuuugccgcagacgacucgcccga

SEQ ID NO: 13787 - RNA, 50 nt, Artificial Sequence
  Description of Artificial Sequence: Synthetic oligonucleotide
gggaggacgaugcgguuugggguuuuccgugccgcagacgacucgcccga

SEQ ID NO: 13788 - RNA, 51 nt, Artificial Sequence
  Description of Artificial Sequence: Synthetic oligonucleotide
gggaggacgaugcgguccuggcuugucguuguucccagacgacucgcccga

SEQ ID NO: 13789 - RNA, 51 nt, Artificial Sequence
  Description of Artificial Sequence: Synthetic oligonucleotide
gggaggacgaugcggccuuuacuucuaucuuaccgcagacgacucgcccga

SEQ ID NO: 13790 - RNA, 51 nt, Artificial Sequence
  Description of Artificial Sequence: Synthetic oligonucleotide
gggaggacgaugcgguuucuacacuccuuuuuccgcagacgacucgcccga

SEQ ID NO: 13791 - RNA, 51 nt, Artificial Sequence
  Description of Artificial Sequence: Synthetic oligonucleotide
gggaggacgaugcggaccuuuuccauuuuuuuccgcagacgacucgcccga

SEQ ID NO: 13792 - RNA, 51 nt, Artificial Sequence
  Description of Artificial Sequence: Synthetic oligonucleotide
gggaggacgaugcggaauuuuuguucccuguaccgcagacgacucgcccga

SEQ ID NO: 13793 - RNA, 51 nt, Artificial Sequence
  Description of Artificial Sequence: Synthetic oligonucleotide
gggaggacgaugcgguuucuuuuuuuauccccgugcagacgacucgcccga

SEQ ID NO: 13794 - RNA, 51 nt, Artificial Sequence
  Description of Artificial Sequence: Synthetic oligonucleotide
gggaggacgaugcggucauuucuuucucgccuccgcagacgacucgcccga

SEQ ID NO: 13795 - RNA, 51 nt, Artificial Sequence
  Description of Artificial Sequence: Synthetic oligonucleotide
gggaggacgaugcggacgcuuucuccuuuucuccgcagacgacucgcccga

SEQ ID NO: 13796 - RNA, 52 nt, Artificial Sequence
  Description of Artificial Sequence: Synthetic oligonucleotide
gggaggacgaugcgguuuuuguuuuguuuuuuggugcagacgacucgcccga

SEQ ID NO: 13797 - RNA, 51 nt, Artificial Sequence
  Description of Artificial Sequence: Synthetic oligonucleotide
gggaggacgaugcggucuuuauguuccuuuuuccccagacgacucgcccga

SEQ ID NO: 13798 - RNA, 51 nt, Artificial Sequence
  Description of Artificial Sequence: Synthetic oligonucleotide
gggaggacgaugcggcuuuucuuuuuuuuccgcgccagacgacucgcccga

SEQ ID NO: 13799 - RNA, 51 nt, Artificial Sequence
  Description of Artificial Sequence: Synthetic oligonucleotide
gggaggacgaugcggcauuucuucuucuuucagcccagacgacucgcccga

SEQ ID NO: 13800 - RNA, 52 nt, Artificial Sequence
  Description of Artificial Sequence: Synthetic oligonucleotide
gggaggacgaugcgguuuuguuuuucucuuuuuccgcagacgacucgcccga

SEQ ID NO: 13801 - RNA, 51 nt, Artificial Sequence
  Description of Artificial Sequence: Synthetic oligonucleotide
gggaggacgaugcgguuugggaguaggguguuacgcagacgacucgcccga

SEQ ID NO: 13802 - RNA, 51 nt, Artificial Sequence
  Description of Artificial Sequence: Synthetic oligonucleotide
gggaggacgaugcggaugcuuggaguaggguggugcagacgacucgcccga

SEQ ID NO: 13803 - RNA, 51 nt, Artificial Sequence
  Description of Artificial Sequence: Synthetic oligonucleotide
gggaggacgaugcggcuuuuuucauucgcguuccgcagacgacucgcccga

SEQ ID NO: 13804 - RNA, 52 nt, Artificial Sequence
  Description of Artificial Sequence: Synthetic oligonucleotide
gggaggacgaugcggauuuuucuucuucuuuuaccgcagacgacucgcccga

SEQ ID NO: 13805 - RNA, 51 nt, Artificial Sequence
  Description of Artificial Sequence: Synthetic oligonucleotide
gggaggacgaugcggcucauuuuuuuccgucuccgcagacgacucgcccga

SEQ ID NO: 13806 - RNA, 51 nt, Artificial Sequence
  Description of Artificial Sequence: Synthetic oligonucleotide
gggaggacgaugcggucuuuuuaucaucuuuccugcagacgacucgcccga

SEQ ID NO: 13807 - RNA, 51 nt, Artificial Sequence
  Description of Artificial Sequence: Synthetic oligonucleotide
gggaggacgaugcggcuuuuuacuguucuuuucugcagacgacucgcccga

SEQ ID NO: 13808 - RNA, 51 nt, Artificial Sequence
  Description of Artificial Sequence: Synthetic oligonucleotide
gggaggacgaugcgguuuccauauuuacuuucccgcagacgacucgcccga

SEQ ID NO: 13809 - RNA, 51 nt, Artificial Sequence
  Description of Artificial Sequence: Synthetic oligonucleotide
gggaggacgaugcggcuuuaucguguuucuuaccgcagacgacucgcccga

SEQ ID NO: 13810 - RNA, 51 nt, Artificial Sequence
  Description of Artificial Sequence: Synthetic oligonucleotide
gggaggacgaugcggcuuacucacuacuuucuccgcagacgacucgcccga

SEQ ID NO: 13811 - RNA, 51 nt, Artificial Sequence
  Description of Artificial Sequence: Synthetic oligonucleotide
gggaggacgaugcgggguucuuuuuucuccauccccagacgacucgcccga

SEQ ID NO: 13812 - RNA, 51 nt, Artificial Sequence
  Description of Artificial Sequence: Synthetic oligonucleotide
gggaggacgaugcgguaccacuuuauuuuuccccgcagacgacucgcccga

SEQ ID NO: 13813 - RNA, 51 nt, Artificial Sequence
  Description of Artificial Sequence: Synthetic oligonucleotide
gggaggacgaugcgguuuuucagucuauuuuuccgcagacgacucgcccga

SEQ ID NO: 13814 - RNA, 51 nt, Artificial Sequence
  Description of Artificial Sequence: Synthetic oligonucleotide
gggaggacgaugcggauucuuuuacucugcuaccgcagacgacucgcccga

SEQ ID NO: 13815 - RNA, 52 nt, Artificial Sequence
  Description of Artificial Sequence: Synthetic oligonucleotide
gggaggacgaugcggcuuuuucguuuuuuucuuccgcagacgacucgcccga

SEQ ID NO: 13816 - RNA, 53 nt, Artificial Sequence
  Description of Artificial Sequence: Synthetic oligonucleotide
gggaggacgaugcggauuuuuguauucuuuuuugccccagacgacucgcccga

SEQ ID NO: 13817 - RNA, 51 nt, Artificial Sequence
  Description of Artificial Sequence: Synthetic oligonucleotide
gggaggacgaugcggccauuuacacuuauuuuccgcagacgacucgcccga

SEQ ID NO: 13818 - RNA, 51 nt, Artificial Sequence
  Description of Artificial Sequence: Synthetic oligonucleotide
gggaggacgaugcgguuuuuguuaauccuuuugcccagacgacucgcccga

SEQ ID NO: 13819 - RNA, 51 nt, Artificial Sequence
  Description of Artificial Sequence: Synthetic oligonucleotide
gggaggacgaugcggaacuuuacuuucccuuuccccagacgacucgcccga

SEQ ID NO: 13820 - RNA, 50 nt, Artificial Sequence
  Description of Artificial Sequence: Synthetic oligonucleotide
gggaggacgaugcggcuucuuuucucgcuuuccgcagacgacucgcccga

SEQ ID NO: 13821 - RNA, 51 nt, Artificial Sequence
  Description of Artificial Sequence: Synthetic oligonucleotide
gggaggacgaugcgguauuuuuauuucuuugucugcagacgacucgcccga

SEQ ID NO: 13822 - RNA, 51 nt, Artificial Sequence
  Description of Artificial Sequence: Synthetic oligonucleotide
gggaggacgaugcgguuacuuuuaaauucgcucugcagacgacucgcccga

SEQ ID NO: 13823 - RNA, 51 nt, Artificial Sequence
  Description of Artificial Sequence: Synthetic oligonucleotide
gggaggacgaugcgguccuuuacauuuucuuuccgcagacgacucgcccga

SEQ ID NO: 13824 - RNA, 51 nt, Artificial Sequence
  Description of Artificial Sequence: Synthetic oligonucleotide
gggaggacgaugcggcuuuaguuucauuuuuuccgcagacgacucgcccga

SEQ ID NO: 13825 - RNA, 50 nt, Artificial Sequence
  Description of Artificial Sequence: Synthetic oligonucleotide
gggaggacgaugcgguuucugacacuuuuuuccgcagacgacucgcccga

SEQ ID NO: 13826 - RNA, 51 nt, Artificial Sequence
  Description of Artificial Sequence: Synthetic oligonucleotide
gggaggacgaugcggugcuuaggaggauggaggugcagacgacucgcccga

SEQ ID NO: 13827 - RNA, 51 nt, Artificial Sequence
  Description of Artificial Sequence: Synthetic oligonucleotide
gggaggacgaugcgguuucaugcccauucuuuccgcagacgacucgcccga

SEQ ID NO: 13828 - RNA, 51 nt, Artificial Sequence
  Description of Artificial Sequence: Synthetic oligonucleotide
gggaggacgaugcgggugucuuucuuucuuuuccccagacgacucgcccga

SEQ ID NO: 13829 - RNA, 51 nt, Artificial Sequence
  Description of Artificial Sequence: Synthetic oligonucleotide
gggaggacgaugcggucauuuucuuuuuuccccaccagacgacucgcccga

SEQ ID NO: 13830 - RNA, 51 nt, Artificial Sequence
  Description of Artificial Sequence: Synthetic oligonucleotide
gggaggacgaugcggagggauuggagguguacccgcagacgacucgcccga

SEQ ID NO: 13831 - RNA, 52 nt, Artificial Sequence
  Description of Artificial Sequence: Synthetic oligonucleotide
gggaggacgaugcgguuuauuuucuucucauuuccucagacgacucgcccga

SEQ ID NO: 13832 - RNA, 50 nt, Artificial Sequence
  Description of Artificial Sequence: Synthetic oligonucleotide
gggaggacgaugcggauuucuuuccuuuuuaccgcagacgacucgcccga

SEQ ID NO: 13833 - RNA, 53 nt, Artificial Sequence
  Description of Artificial Sequence: Synthetic oligonucleotide
gggaggacgaugcggcuauccuuguuuuuuucuuccgcagacgacucgcccga

SEQ ID NO: 13834 - RNA, 51 nt, Artificial Sequence
  Description of Artificial Sequence: Synthetic oligonucleotide
gggaggacgaugcggcuuuuuucccaccauuuccgcagacgacucgcccga

SEQ ID NO: 13835 - RNA, 52 nt, Artificial Sequence
  Description of Artificial Sequence: Synthetic oligonucleotide
gggaggacgaugcggaucgcucuauuuuuuucuccgcagacgacucgcccga

SEQ ID NO: 13836 - RNA, 50 nt, Artificial Sequence
  Description of Artificial Sequence: Synthetic oligonucleotide
gggaggacgaugcggcuuucuucgcuuuuuaccgcagacgacucgcccga

SEQ ID NO: 13837 - RNA, 51 nt, Artificial Sequence
  Description of Artificial Sequence: Synthetic oligonucleotide
gggaggacgaugcggcuauaucauuucucuuuccgcagacgacucgcccga

SEQ ID NO: 13838 - RNA, 51 nt, Artificial Sequence
  Description of Artificial Sequence: Synthetic oligonucleotide
gggaggacgaugcggcuuuccaauuccuuuuuccgcagacgacucgcccga

SEQ ID NO: 13839 - RNA, 51 nt, Artificial Sequence
  Description of Artificial Sequence: Synthetic oligonucleotide
gggaggacgaugcggaauuccuuuguuucuuaccgcagacgacucgcccga

SEQ ID NO: 13840 - RNA, 51 nt, Artificial Sequence
  Description of Artificial Sequence: Synthetic oligonucleotide
gggaggacgaugcggccuuuuauuuuuuuucuccgcagacgacucgcccga

SEQ ID NO: 13841 - RNA, 51 nt, Artificial Sequence
  Description of Artificial Sequence: Synthetic oligonucleotide
gggaggacgaugcggcuuacauuacccuuuuuccgcagacgacucgcccga

SEQ ID NO: 13842 - RNA, 52 nt, Artificial Sequence
  Description of Artificial Sequence: Synthetic oligonucleotide
gggaggacgaugcggaacuuguuuuuuuuuuaccgccagacgacucgcccga

SEQ ID NO: 13843 - RNA, 51 nt, Artificial Sequence
  Description of Artificial Sequence: Synthetic oligonucleotide
gggaggacgaugcggcuacuuacucuuauucuccgcagacgacucgcccga

SEQ ID NO: 13844 - RNA, 52 nt, Artificial Sequence
  Description of Artificial Sequence: Synthetic oligonucleotide
gggaggacgaugcggucuuuucacuuacuuuuuccgcagacgacucgcccga

SEQ ID NO: 13845 - RNA, 51 nt, Artificial Sequence
  Description of Artificial Sequence: Synthetic oligonucleotide
gggaggacgaugcggcuugucacacucuuuuuccgcagacgacucgcccga

SEQ ID NO: 13846 - RNA, 51 nt, Artificial Sequence
  Description of Artificial Sequence: Synthetic oligonucleotide
gggaggacgaugcggccaauuauucuuuucuaccgcagacgacucgcccga

SEQ ID NO: 13847 - RNA, 51 nt, Artificial Sequence
  Description of Artificial Sequence: Synthetic oligonucleotide
gggaggacgaugcggucuuucucuuauuuacuccccagacgacucgcccga

SEQ ID NO: 13848 - RNA, 52 nt, Artificial Sequence
  Description of Artificial Sequence: Synthetic oligonucleotide
gggaggacgaugcggauucuuuuuuuguuuuuugcccagacgacucgcccga

SEQ ID NO: 13849 - RNA, 51 nt, Artificial Sequence
  Description of Artificial Sequence: Synthetic oligonucleotide
gggaggacgaugcggcuucuucuauauacucuccgcagacgacucgcccga

SEQ ID NO: 13850 - RNA, 51 nt, Artificial Sequence
  Description of Artificial Sequence: Synthetic oligonucleotide
gggaggacgaugcggcuuucuuuauucucucuugccagacgacucgcccga

SEQ ID NO: 13851 - RNA, 51 nt, Artificial Sequence
  Description of Artificial Sequence: Synthetic oligonucleotide
gggaggacgaugcgguucuauuaaccuuuuucccgcagacgacucgcccga

SEQ ID NO: 13852 - RNA, 51 nt, Artificial Sequence
  Description of Artificial Sequence: Synthetic oligonucleotide
gggaggacgaugcggcuuuuuguugcuuuauuccgcagacgacucgcccga

SEQ ID NO: 13853 - RNA, 52 nt, Artificial Sequence
  Description of Artificial Sequence: Synthetic oligonucleotide
gggaggacgaugcgguuuuuacccuuuuuuuguccucagacgacucgcccga

SEQ ID NO: 13854 - RNA, 52 nt, Artificial Sequence
  Description of Artificial Sequence: Synthetic oligonucleotide
gggaggacgaugcggauuuuuuucucuuauuugccgcagacgacucgcccga

SEQ ID NO: 13855 - RNA, 53 nt, Artificial Sequence
  Description of Artificial Sequence: Synthetic oligonucleotide
gggaggacgaugcgguuuuucucuuuuuuuuccgccgcagacgacucgcccga

SEQ ID NO: 13856 - RNA, 52 nt, Artificial Sequence
  Description of Artificial Sequence: Synthetic oligonucleotide
gggaggacgaugcgguuauuuauuuuuuuucgcccgcagacgacucgcccga

SEQ ID NO: 13857 - RNA, 52 nt, Artificial Sequence
  Description of Artificial Sequence: Synthetic oligonucleotide
gggaggacgaugcgggauauuuucucuuuuuuugcccagacgacucgcccga

SEQ ID NO: 13858 - RNA, 51 nt, Artificial Sequence
  Description of Artificial Sequence: Synthetic oligonucleotide
gggaggacgaugcgguucauuuguuuuuuuucgugcagacgacucgcccga

SEQ ID NO: 13859 - RNA, 53 nt, Artificial Sequence
  Description of Artificial Sequence: Synthetic oligonucleotide
gggaggacgaugcggauuucacugucuuuuuuucccgcagacgacucgcccga

SEQ ID NO: 13860 - RNA, 52 nt, Artificial Sequence
  Description of Artificial Sequence: Synthetic oligonucleotide
gggaggacgaugcggucuguuuuacuuuuuuuuccccagacgacucgcccga

SEQ ID NO: 13861 - RNA, 51 nt, Artificial Sequence
  Description of Artificial Sequence: Synthetic oligonucleotide
gggaggacgaugcgggcuuuuuaucguuuuuuccgcagacgacucgcccga

SEQ ID NO: 13862 - RNA, 51 nt, Artificial Sequence
  Description of Artificial Sequence: Synthetic oligonucleotide
gggaggacgaugcggcuuauuacuuuuuuuuugcccagacgacucgcccga

SEQ ID NO: 13863 - RNA, 52 nt, Artificial Sequence
  Description of Artificial Sequence: Synthetic oligonucleotide
gggaggacgaugcggucuuuuuuaacuuuuucuccgcagacgacucgcccga

SEQ ID NO: 13864 - RNA, 51 nt, Artificial Sequence
  Description of Artificial Sequence: Synthetic oligonucleotide
gggaggacgaugcggacacuucucuuuuucuaccgcagacgacucgcccga

SEQ ID NO: 13865 - RNA, 51 nt, Artificial Sequence
  Description of Artificial Sequence: Synthetic oligonucleotide
gggaggacgaugcgguccugacgucuguugguccccagacgacucgcccga

SEQ ID NO: 13866 - RNA, 50 nt, Artificial Sequence
  Description of Artificial Sequence: Synthetic oligonucleotide
gggaggacgaugcgguccugucgucugcccuccccagacgacucgcccga

SEQ ID NO: 13867 - RNA, 51 nt, Artificial Sequence
  Description of Artificial Sequence: Synthetic oligonucleotide
gggaggacgaugcgguccuugucgucuuccguccccagacgacucgcccga

SEQ ID NO: 13868 - RNA, 51 nt, Artificial Sequence
  Description of Artificial Sequence: Synthetic oligonucleotide
gggaggacgaugcgguccugucgucugcucgcccccagacgacucgcccga

SEQ ID NO: 13869 - RNA, 51 nt, Artificial Sequence
  Description of Artificial Sequence: Synthetic oligonucleotide
gggaggacgaugcgguccugucggcgguucguccccagacgacucgcccga

SEQ ID NO: 13870 - RNA, 51 nt, Artificial Sequence
  Description of Artificial Sequence: Synthetic oligonucleotide
gggaggacgaugcggauucacuucucuucuugccgcagacgacucgcccga

SEQ ID NO: 13871 - RNA, 51 nt, Artificial Sequence
  Description of Artificial Sequence: Synthetic oligonucleotide
gggaggacgaugcggaauuauguguuuuuugaccgcagacgacucgcccga

SEQ ID NO: 13872 - RNA, 51 nt, Artificial Sequence
  Description of Artificial Sequence: Synthetic oligonucleotide
gggaggacgaugcgguuugggaguaggguguuccucagacgacucgcccga

SEQ ID NO: 13873 - RNA, 51 nt, Artificial Sequence
  Description of Artificial Sequence: Synthetic oligonucleotide
gggaggacgaugcgguaucuucuucuuuuucuccgcagacgacucgcccga

SEQ ID NO: 13874 - RNA, 51 nt, Artificial Sequence
  Description of Artificial Sequence: Synthetic oligonucleotide
gggaggacgaugcggauuucuuuuccuuuuuuccgcagacgacucgcccga

SEQ ID NO: 13875 - RNA, 52 nt, Artificial Sequence
  Description of Artificial Sequence: Synthetic oligonucleotide
gggaggacgaugcgguauuccuuguucucuuugccgcagacgacucgcccga

SEQ ID NO: 13876 - RNA, 50 nt, Artificial Sequence
  Description of Artificial Sequence: Synthetic oligonucleotide
gggaggacgaugcggacuuucuucuuucuugccgcagacgacucgcccga

SEQ ID NO: 13877 - RNA, 50 nt, Artificial Sequence
  Description of Artificial Sequence: Synthetic oligonucleotide
gggaggacgaugcggacuuuauccugcaaguccccagacgacucgcccga

SEQ ID NO: 13878 - RNA, 53 nt, Artificial Sequence
  Description of Artificial Sequence: Synthetic oligonucleotide
gggaggacgaugcggaauuauguguuuuuugugacugcagacgacucgcccga

SEQ ID NO: 13879 - RNA, 51 nt, Artificial Sequence
  Description of Artificial Sequence: Synthetic oligonucleotide
gggaggacgaugcgguucucuuguuguuuuugccccagacgacucgcccga

SEQ ID NO: 13880 - RNA, 51 nt, Artificial Sequence
  Description of Artificial Sequence: Synthetic oligonucleotide
gggaggacgaugcggucugggguuuucacuguccgcagacgacucgcccga

SEQ ID NO: 13881 - RNA, 51 nt, Artificial Sequence
  Description of Artificial Sequence: Synthetic oligonucleotide
gggaggacgaugcgguuggguguagggagguuccgcagacgacucgcccga

SEQ ID NO: 13882 - RNA, 51 nt, Artificial Sequence
  Description of Artificial Sequence: Synthetic oligonucleotide
gggaggacgaugcggaaggguguagggugguaccgcagacgacucgcccga

SEQ ID NO: 13883 - RNA, 51 nt, Artificial Sequence
  Description of Artificial Sequence: Synthetic oligonucleotide
gggaggacgaugcggauuuccuuuccuuuuuaccgcagacgacucgcccga

SEQ ID NO: 13884 - RNA, 51 nt, Artificial Sequence
  Description of Artificial Sequence: Synthetic oligonucleotide
gggaggacgaugcgguucuuuuccuucuuucuccgcagacgacucgcccga

SEQ ID NO: 13885 - RNA, 49 nt, Artificial Sequence
  Description of Artificial Sequence: Synthetic oligonucleotide
gggaggacgaugcggccuuucguucugccuccccagacgacucgcccga

SEQ ID NO: 13886 - RNA, 51 nt, Artificial Sequence
  Description of Artificial Sequence: Synthetic oligonucleotide
gggaggacgaugcgguccuguuauucucuucuccgcagacgacucgcccga

SEQ ID NO: 13887 - RNA, 51 nt, Artificial Sequence
  Description of Artificial Sequence: Synthetic oligonucleotide
gggaggacgaugcgguuuuauuauucucugcugcccagacgacucgcccga

SEQ ID NO: 13888 - RNA, 51 nt, Artificial Sequence
  Description of Artificial Sequence: Synthetic oligonucleotide
gggaggacgaugcgguuuguuuuaucuuuuguccccagacgacucgcccga

SEQ ID NO: 13889 - RNA, 50 nt, Artificial Sequence
  Description of Artificial Sequence: Synthetic oligonucleotide
gggaggacgaugcggccuuuucuuuccuauuccgcagacgacucgcccga

SEQ ID NO: 13890 - RNA, 51 nt, Artificial Sequence
  Description of Artificial Sequence: Synthetic oligonucleotide
gggaggacgaugcggcuacucuuuucuuaccuccgcagacgacucgcccga

SEQ ID NO: 13891 - RNA, 51 nt, Artificial Sequence
  Description of Artificial Sequence: Synthetic oligonucleotide
gggaggacgaugcgguuuuacuauucacuuuccgccagacgacucgcccga

SEQ ID NO: 13892 - RNA, 51 nt, Artificial Sequence
  Description of Artificial Sequence: Synthetic oligonucleotide
gggaggacgaugcgguccaguuucuauuuucuccgcagacgacucgcccga

SEQ ID NO: 13893 - RNA, 49 nt, Artificial Sequence
  Description of Artificial Sequence: Synthetic oligonucleotide
gggaggacgaugcggauuuucucuuuuuugccgcagacgacucgcccga

SEQ ID NO: 13894 - RNA, 51 nt, Artificial Sequence
  Description of Artificial Sequence: Synthetic oligonucleotide
gggaggacgaugcgguaucauuauuauuuccuccgcagacgacucgcccga

SEQ ID NO: 13895 - RNA, 51 nt, Artificial Sequence
  Description of Artificial Sequence: Synthetic oligonucleotide
gggaggacgaugcggucuuuucauguuuuucuccgcagacgacucgcccga

SEQ ID NO: 13896 - RNA, 51 nt, Artificial Sequence
  Description of Artificial Sequence: Synthetic oligonucleotide
gggaggacgaugcggacaucucacuuucucuaccgcagacgacucgcccga

SEQ ID NO: 13897 - RNA, 51 nt, Artificial Sequence
  Description of Artificial Sequence: Synthetic oligonucleotide
gggaggacgaugcggaucauuuuccuacuucuccgcagacgacucgcccga

SEQ ID NO: 13898 - RNA, 50 nt, Artificial Sequence
  Description of Artificial Sequence: Synthetic oligonucleotide
gggaggacgaugcgggccuuucguucugcuuccccagacgacucgcccga

SEQ ID NO: 13899 - RNA, 51 nt, Artificial Sequence
  Description of Artificial Sequence: Synthetic oligonucleotide
gggaggacgaugcggccuuaucucuacucuuuccgcagacgacucgcccga

SEQ ID NO: 13900 - RNA, 49 nt, Artificial Sequence
  Description of Artificial Sequence: Synthetic oligonucleotide
gggaggacgaugcgggccuuucguucucccccccagacgacucgcccga

SEQ ID NO: 13901 - RNA, 50 nt, Artificial Sequence
  Description of Artificial Sequence: Synthetic oligonucleotide
gggaggacgaugcgggcauucguucugcccuccccagacgacucgcccga

SEQ ID NO: 13902 - RNA, 52 nt, Artificial Sequence
  Description of Artificial Sequence: Synthetic oligonucleotide
gggaggacgaugcggauuacucuucucuuuuugccgcagacgacucgcccga

SEQ ID NO: 13903 - RNA, 51 nt, Artificial Sequence
  Description of Artificial Sequence: Synthetic oligonucleotide
gggaggacgaugcgguucauuuucuuuccucuccgcagacgacucgcccga

SEQ ID NO: 13904 - RNA, 52 nt, Artificial Sequence
  Description of Artificial Sequence: Synthetic oligonucleotide
gggaggacgaugcgguuuacuucuuuccacguuccgcagacgacucgcccga

SEQ ID NO: 13905 - RNA, 51 nt, Artificial Sequence
  Description of Artificial Sequence: Synthetic oligonucleotide
gggaggacgaugcgguguuuuguuugcuuuauccccagacgacucgcccga

SEQ ID NO: 13906 - RNA, 51 nt, Artificial Sequence
  Description of Artificial Sequence: Synthetic oligonucleotide
gggaggacgaugcggguuuuccuucuuuucgcccgcagacgacucgcccga

SEQ ID NO: 13907 - RNA, 51 nt, Artificial Sequence
  Description of Artificial Sequence: Synthetic oligonucleotide
gggaggacgaugcggcuuuucucuucauuuuaccgcagacgacucgcccga

SEQ ID NO: 13908 - RNA, 51 nt, Artificial Sequence
  Description of Artificial Sequence: Synthetic oligonucleotide
gggaggacgaugcggccuuauuacuaccuuuuccgcagacgacucgcccga

SEQ ID NO: 13909 - RNA, 51 nt, Artificial Sequence
  Description of Artificial Sequence: Synthetic oligonucleotide
gggaggacgaugcgguuuauuacuacuucguuccgcagacgacucgcccga

SEQ ID NO: 13910 - RNA, 50 nt, Artificial Sequence
  Description of Artificial Sequence: Synthetic oligonucleotide
gggaggacgaugcgguuuuuugauuuuguuuccgcagacgacucgcccga

SEQ ID NO: 13911 - RNA, 51 nt, Artificial Sequence
  Description of Artificial Sequence: Synthetic oligonucleotide
gggaggacgaugcgguacuuguucuacuuucuccgcagacgacucgcccga

SEQ ID NO: 13912 - RNA, 51 nt, Artificial Sequence
  Description of Artificial Sequence: Synthetic oligonucleotide
gggaggacgaugcggauucuugcuuauauucaccgcagacgacucgcccga

SEQ ID NO: 13913 - RNA, 51 nt, Artificial Sequence
  Description of Artificial Sequence: Synthetic oligonucleotide
gggaggacgaugcggcuuacucuuuuuauucaccgcagacgacucgcccga

SEQ ID NO: 13914 - RNA, 51 nt, Artificial Sequence
  Description of Artificial Sequence: Synthetic oligonucleotide
gggaggacgaugcggccuuucucuuguuucuugcccagacgacucgcccga

SEQ ID NO: 13915 - RNA, 51 nt, Artificial Sequence
  Description of Artificial Sequence: Synthetic oligonucleotide
gggaggacgaugcgggauucuuacucuuauuuccccagacgacucgcccga

SEQ ID NO: 13916 - RNA, 51 nt, Artificial Sequence
  Description of Artificial Sequence: Synthetic oligonucleotide
gggaggacgaugcgggccuuucggucuucccuccccagacgacucgcccga

SEQ ID NO: 13917 - RNA, 51 nt, Artificial Sequence
  Description of Artificial Sequence: Synthetic oligonucleotide
gggaggacgaugcggauuacuucuauuucuuaccccagacgacucgcccga

SEQ ID NO: 13918 - RNA, 50 nt, Artificial Sequence
  Description of Artificial Sequence: Synthetic oligonucleotide
gggaggacgaugcggacuuuuuucuuuucuaccgcagacgacucgcccga

SEQ ID NO: 13919 - RNA, 51 nt, Artificial Sequence
  Description of Artificial Sequence: Synthetic oligonucleotide
gggaggacgaugcggccauuuuuguuccuuuuccgcagacgacucgcccga

SEQ ID NO: 13920 - RNA, 52 nt, Artificial Sequence
  Description of Artificial Sequence: Synthetic oligonucleotide
gggaggacgaugcgguuuccggguuuuuuuuugccgcagacgacucgcccga

SEQ ID NO: 13921 - RNA, 49 nt, Artificial Sequence
  Description of Artificial Sequence: Synthetic oligonucleotide
gggaggacgaugcggcuuuucucucuuuuuccgcagacgacucgcccga

SEQ ID NO: 13922 - RNA, 51 nt, Artificial Sequence
  Description of Artificial Sequence: Synthetic oligonucleotide
gggaggacgaugcgguccuuucguucuguucuccccagacgacucgcccga

SEQ ID NO: 13923 - RNA, 52 nt, Artificial Sequence
  Description of Artificial Sequence: Synthetic oligonucleotide
gggaggacgaugcggcguuauuuucuccuuggucgccagacgacucgcccga

SEQ ID NO: 13924 - RNA, 51 nt, Artificial Sequence
  Description of Artificial Sequence: Synthetic oligonucleotide
gggaggacgaugcggcucauuuucucuccuuuccgcagacgacucgcccga

SEQ ID NO: 13925 - RNA, 51 nt, Artificial Sequence
  Description of Artificial Sequence: Synthetic oligonucleotide
gggaggacgaugcgguuauuuuucacuucucacgccagacgacucgcccga

SEQ ID NO: 13926 - RNA, 51 nt, Artificial Sequence
  Description of Artificial Sequence: Synthetic oligonucleotide
gggaggacgaugcggauauucguuauuuuugugcccagacgacucgcccga

SEQ ID NO: 13927 - RNA, 51 nt, Artificial Sequence
  Description of Artificial Sequence: Synthetic oligonucleotide
gggaggacgaugcgguaucuuuuguuuuuccucgccagacgacucgcccga

SEQ ID NO: 13928 - RNA, 51 nt, Artificial Sequence
  Description of Artificial Sequence: Synthetic oligonucleotide
gggaggacgaugcggcuucuugcagucuuuuuccgcagacgacucgcccga

SEQ ID NO: 13929 - RNA, 51 nt, Artificial Sequence
  Description of Artificial Sequence: Synthetic oligonucleotide
gggaggacgaugcggucucuucauguuucucuccgcagacgacucgcccga

SEQ ID NO: 13930 - RNA, 51 nt, Artificial Sequence
  Description of Artificial Sequence: Synthetic oligonucleotide
gggaggacgaugcgguuugaagggcgauagguccgcagacgacucgcccga

SEQ ID NO: 13931 - RNA, 51 nt, Artificial Sequence
  Description of Artificial Sequence: Synthetic oligonucleotide
gggaggacgaugcggccuuuacuguuucgcuuccgcagacgacucgcccga

SEQ ID NO: 13932 - RNA, 51 nt, Artificial Sequence
  Description of Artificial Sequence: Synthetic oligonucleotide
gggaggacgaugcggucucuguuguauuuccuccgcagacgacucgcccga

SEQ ID NO: 13933 - RNA, 50 nt, Artificial Sequence
  Description of Artificial Sequence: Synthetic oligonucleotide
gggaggacgaugcggauucucuuucuuuuuaccgcagacgacucgcccga

SEQ ID NO: 13934 - RNA, 52 nt, Artificial Sequence
  Description of Artificial Sequence: Synthetic oligonucleotide
gggaggacgaugcgguacuuuuuuucccuuugcgugcagacgacucgcccga

SEQ ID NO: 13935 - RNA, 49 nt, Artificial Sequence
  Description of Artificial Sequence: Synthetic oligonucleotide
gggaggacgaugcgguuuuuuuucuuguuuccgcagacgacucgcccga

SEQ ID NO: 13936 - RNA, 51 nt, Artificial Sequence
  Description of Artificial Sequence: Synthetic oligonucleotide
gggaggacgaugcggauuuuugacuucuuuacccgcagacgacucgcccga

SEQ ID NO: 13937 - RNA, 51 nt, Artificial Sequence
  Description of Artificial Sequence: Synthetic oligonucleotide
gggaggacgaugcgguuuauuuucuucuuuugcaccagacgacucgcccga

SEQ ID NO: 13938 - RNA, 51 nt, Artificial Sequence
  Description of Artificial Sequence: Synthetic oligonucleotide
gggaggacgaugcggcuauuuuauuguuuucucugcagacgacucgcccga

SEQ ID NO: 13939 - RNA, 51 nt, Artificial Sequence
  Description of Artificial Sequence: Synthetic oligonucleotide
gggaggacgaugcgguuauccugacuccguacguccagacgacucgcccga

SEQ ID NO: 13940 - RNA, 51 nt, Artificial Sequence
  Description of Artificial Sequence: Synthetic oligonucleotide
gggaggacgaugcggucuuuauuucauuuccgccgcagacgacucgcccga

SEQ ID NO: 13941 - RNA, 51 nt, Artificial Sequence
  Description of Artificial Sequence: Synthetic oligonucleotide
gggaggacgaugcggcaugcuuuacuuuuuuuccgcagacgacucgcccga

SEQ ID NO: 13942 - RNA, 51 nt, Artificial Sequence
  Description of Artificial Sequence: Synthetic oligonucleotide
gggaggacgaugcggauacgcucuuauuuuugccgcagacgacucgcccga

SEQ ID NO: 13943 - RNA, 50 nt, Artificial Sequence
  Description of Artificial Sequence: Synthetic oligonucleotide
gggaggacgaugcggucuuuaauuuugcuccccgcagacgacucgcccga

SEQ ID NO: 13944 - RNA, 50 nt, Artificial Sequence
  Description of Artificial Sequence: Synthetic oligonucleotide
gggaggacgaugcgguuaguuuuuauuuuguuugcagacgacucgcccga

SEQ ID NO: 13945 - RNA, 53 nt, Artificial Sequence
  Description of Artificial Sequence: Synthetic oligonucleotide
gggaggacgaugcgguuugaacucuuuuuuuuuuccgcagacgacucgcccga

SEQ ID NO: 13946 - RNA, 51 nt, Artificial Sequence
  Description of Artificial Sequence: Synthetic oligonucleotide
gggaggacgaugcgguuuuucuucuauucgcuccacagacgacucgcccga

SEQ ID NO: 13947 - RNA, 51 nt, Artificial Sequence
  Description of Artificial Sequence: Synthetic oligonucleotide
gggaggacgaugcggauuuugauaauuuugcucugcagacgacucgcccga

SEQ ID NO: 13948 - RNA, 51 nt, Artificial Sequence
  Description of Artificial Sequence: Synthetic oligonucleotide
gggaggacgaugcggauucuguuguuuuccuaccgcagacgacucgcccga

SEQ ID NO: 13949 - RNA, 51 nt, Artificial Sequence
  Description of Artificial Sequence: Synthetic oligonucleotide
gggaggacgaugcgguuuauuguauuuuuccuuggcagacgacucgcccga

SEQ ID NO: 13950 - RNA, 51 nt, Artificial Sequence
  Description of Artificial Sequence: Synthetic oligonucleotide
gggaggacgaugcggcuuauuuacgguuucuuccgcagacgacucgcccga

SEQ ID NO: 13951 - RNA, 51 nt, Artificial Sequence
  Description of Artificial Sequence: Synthetic oligonucleotide
gggaggacgaugcggcucuaccuuuuuaucuuccgcagacgacucgcccga

SEQ ID NO: 13952 - RNA, 51 nt, Artificial Sequence
  Description of Artificial Sequence: Synthetic oligonucleotide
gggaggacgaugcgguucuuuucucuguucacccgcagacgacucgcccga

SEQ ID NO: 13953 - RNA, 52 nt, Artificial Sequence
  Description of Artificial Sequence: Synthetic oligonucleotide
gggaggacgaugcggauuuuuuaacuuuacgcuccccagacgacucgcccga

SEQ ID NO: 13954 - RNA, 51 nt, Artificial Sequence
  Description of Artificial Sequence: Synthetic oligonucleotide
gggaggacgaugcggcuuucugucuuuuacuaccgcagacgacucgcccga

SEQ ID NO: 13955 - RNA, 52 nt, Artificial Sequence
  Description of Artificial Sequence: Synthetic oligonucleotide
gggaggacgaugcggucacuuuuuuuuucuaccccgcagacgacucgcccga

SEQ ID NO: 13956 - RNA, 51 nt, Artificial Sequence
  Description of Artificial Sequence: Synthetic oligonucleotide
gggaggacgaugcgguacuauuuucuucacuugcccagacgacucgcccga

SEQ ID NO: 13957 - RNA, 51 nt, Artificial Sequence
  Description of Artificial Sequence: Synthetic oligonucleotide
gggaggacgaugcgguacuuuuucuuuccuuacgccagacgacucgcccga

SEQ ID NO: 13958 - RNA, 51 nt, Artificial Sequence
  Description of Artificial Sequence: Synthetic oligonucleotide
gggaggacgaugcggaccacuuuuauccuauuccgcagacgacucgcccga

SEQ ID NO: 13959 - RNA, 51 nt, Artificial Sequence
  Description of Artificial Sequence: Synthetic oligonucleotide
gggaggacgaugcggacuuaacuuuucucuacccgcagacgacucgcccga

SEQ ID NO: 13960 - RNA, 51 nt, Artificial Sequence
  Description of Artificial Sequence: Synthetic oligonucleotide
gggaggacgaugcgguucuuucuucuuuuucuccgcagacgacucgcccga

SEQ ID NO: 13961 - RNA, 51 nt, Artificial Sequence
  Description of Artificial Sequence: Synthetic oligonucleotide
gggaggacgaugcggauuuccuuuaucucauaccgcagacgacucgcccga

SEQ ID NO: 13962 - RNA, 51 nt, Artificial Sequence
  Description of Artificial Sequence: Synthetic oligonucleotide
gggaggacgaugcggcauuuuacuuuccuucuccgcagacgacucgcccga

SEQ ID NO: 13963 - RNA, 51 nt, Artificial Sequence
  Description of Artificial Sequence: Synthetic oligonucleotide
gggaggacgaugcggcuucaucuuugcucuuaccgcagacgacucgcccga

SEQ ID NO: 13964 - RNA, 51 nt, Artificial Sequence
  Description of Artificial Sequence: Synthetic oligonucleotide
gggaggacgaugcgguuuccacaacuucucuuccgcagacgacucgcccga

SEQ ID NO: 13965 - RNA, 51 nt, Artificial Sequence
  Description of Artificial Sequence: Synthetic oligonucleotide
gggaggacgaugcggguuuaauuuaugcuuuuccgcagacgacucgcccga

SEQ ID NO: 13966 - RNA, 51 nt, Artificial Sequence
  Description of Artificial Sequence: Synthetic oligonucleotide
gggaggacgaugcgguguuacucacuuucuuuccgcagacgacucgcccga

SEQ ID NO: 13967 - RNA, 52 nt, Artificial Sequence
  Description of Artificial Sequence: Synthetic oligonucleotide
gggaggacgaugcgguuucuuuuacguuuuuuuccccagacgacucgcccga

SEQ ID NO: 13968 - RNA, 52 nt, Artificial Sequence
  Description of Artificial Sequence: Synthetic oligonucleotide
gggaggacgaugcgguuuuucaguguuuuuugugugcagacgacucgcccga

SEQ ID NO: 13969 - RNA, 50 nt, Artificial Sequence
  Description of Artificial Sequence: Synthetic oligonucleotide
gggaggacgaugcgguuuuucgaucuuuguuccgcagacgacucgcccga

SEQ ID NO: 13970 - RNA, 51 nt, Artificial Sequence
  Description of Artificial Sequence: Synthetic oligonucleotide
gggaggacgaugcgguuauucucuuucaucuuccgcagacgacucgcccga

SEQ ID NO: 13971 - RNA, 51 nt, Artificial Sequence
  Description of Artificial Sequence: Synthetic oligonucleotide
gggaggacgaugcgguuaccuuucuuuuuacuccgcagacgacucgcccga

SEQ ID NO: 13972 - RNA, 51 nt, Artificial Sequence
  Description of Artificial Sequence: Synthetic oligonucleotide
gggaggacgaugcggcuuugucaacuguuuuuccgcagacgacucgcccga

SEQ ID NO: 13973 - RNA, 51 nt, Artificial Sequence
  Description of Artificial Sequence: Synthetic oligonucleotide
gggaggacgaugcgguucuuuagucacuuuuuccccagacgacucgcccga

SEQ ID NO: 13974 - RNA, 51 nt, Artificial Sequence
  Description of Artificial Sequence: Synthetic oligonucleotide
gggaggacgaugcggcucuacuuucuuaccuuccgcagacgacucgcccga

SEQ ID NO: 13975 - RNA, 51 nt, Artificial Sequence
  Description of Artificial Sequence: Synthetic oligonucleotide
gggaggacgaugcgguuucucuuuucucugcccgccagacgacucgcccga

SEQ ID NO: 13976 - RNA, 50 nt, Artificial Sequence
  Description of Artificial Sequence: Synthetic oligonucleotide
gggaggacgaugcgguuuuucuuuuccuuguccgcagacgacucgcccga

SEQ ID NO: 13977 - RNA, 51 nt, Artificial Sequence
  Description of Artificial Sequence: Synthetic oligonucleotide
gggaggacgaugcgguuuuauucuaacuuucccugcagacgacucgcccga

SEQ ID NO: 13978 - RNA, 51 nt, Artificial Sequence
  Description of Artificial Sequence: Synthetic oligonucleotide
gggaggacgaugcgguuguuuccucuucuuuuccgcagacgacucgcccga

SEQ ID NO: 13979 - RNA, 51 nt, Artificial Sequence
  Description of Artificial Sequence: Synthetic oligonucleotide
gggaggacgaugcggauucuuuucuucucucucgccagacgacucgcccga

SEQ ID NO: 13980 - RNA, 51 nt, Artificial Sequence
  Description of Artificial Sequence: Synthetic oligonucleotide
gggaggacgaugcggacucuuucuucucuuuuccgcagacgacucgcccga

SEQ ID NO: 13981 - RNA, 51 nt, Artificial Sequence
  Description of Artificial Sequence: Synthetic oligonucleotide
gggaggacgaugcgguuuggagggugauggggccgcagacgacucgcccga

SEQ ID NO: 13982 - RNA, 52 nt, Artificial Sequence
  Description of Artificial Sequence: Synthetic oligonucleotide
gggaggacgaugcgguuuuucacuuuuuucgccccucagacgacucgcccga

SEQ ID NO: 13983 - RNA, 51 nt, Artificial Sequence
  Description of Artificial Sequence: Synthetic oligonucleotide
gggaggacgaugcgguuuuucuacuuuccuuuccgcagacgacucgcccga

SEQ ID NO: 13984 - RNA, 51 nt, Artificial Sequence
  Description of Artificial Sequence: Synthetic oligonucleotide
gggaggacgaugcggcuguuucauucuuuuuuccccagacgacucgcccga

SEQ ID NO: 13985 - RNA, 51 nt, Artificial Sequence
  Description of Artificial Sequence: Synthetic oligonucleotide
gggaggacgaugcgguuuauucuuauucuuuugcgcagacgacucgcccga

SEQ ID NO: 13986 - RNA, 51 nt, Artificial Sequence
  Description of Artificial Sequence: Synthetic oligonucleotide
gggaggacgaugcgggccuuuucuccuuucuaccgcagacgacucgcccga

SEQ ID NO: 13987 - RNA, 51 nt, Artificial Sequence
  Description of Artificial Sequence: Synthetic oligonucleotide
gggaggacgaugcgguuuccuguuuguuuucugcgcagacgacucgcccga

SEQ ID NO: 13988 - RNA, 51 nt, Artificial Sequence
  Description of Artificial Sequence: Synthetic oligonucleotide
gggaggacgaugcgguuuuucggacuuuucucccgcagacgacucgcccga

SEQ ID NO: 13989 - RNA, 51 nt, Artificial Sequence
  Description of Artificial Sequence: Synthetic oligonucleotide
gggaggacgaugcgguuuuauuucuacuucuuugccagacgacucgcccga

SEQ ID NO: 13990 - RNA, 51 nt, Artificial Sequence
  Description of Artificial Sequence: Synthetic oligonucleotide
gggaggacgaugcgguuuguuuauucucuuuuccgcagacgacucgcccga

SEQ ID NO: 13991 - RNA, 51 nt, Artificial Sequence
  Description of Artificial Sequence: Synthetic oligonucleotide
gggaggacgaugcgguucuuucuaucucuucuccgcagacgacucgcccga

SEQ ID NO: 13992 - RNA, 51 nt, Artificial Sequence
  Description of Artificial Sequence: Synthetic oligonucleotide
gggaggacgaugcggcuuuuuaccuuuccuuucugcagacgacucgcccga

SEQ ID NO: 13993 - RNA, 53 nt, Artificial Sequence
  Description of Artificial Sequence: Synthetic oligonucleotide
gggaggacgaugcgguuucuuucauuuuuuuuuuccgcagacgacucgcccga

SEQ ID NO: 13994 - RNA, 51 nt, Artificial Sequence
  Description of Artificial Sequence: Synthetic oligonucleotide
gggaggacgaugcgguucacuuacuacuuuuucugcagacgacucgcccga

SEQ ID NO: 13995 - RNA, 51 nt, Artificial Sequence
  Description of Artificial Sequence: Synthetic oligonucleotide
gggaggacgaugcgggucuucuuuuucuuguaccgcagacgacucgcccga

SEQ ID NO: 13996 - RNA, 50 nt, Artificial Sequence
  Description of Artificial Sequence: Synthetic oligonucleotide
gggaggacgaugcggccuuuuacuuuuuuuuccgcagacgacucgcccga

SEQ ID NO: 13997 - RNA, 51 nt, Artificial Sequence
  Description of Artificial Sequence: Synthetic oligonucleotide
gggaggacgaugcggauuuccaacuuuucuuuccgcagacgacucgcccga

SEQ ID NO: 13998 - RNA, 53 nt, Artificial Sequence
  Description of Artificial Sequence: Synthetic oligonucleotide
gggaggacgaugcgguuuuagcuccuuuuuuuguccgcagacgacucgcccga

SEQ ID NO: 13999 - RNA, 51 nt, Artificial Sequence
  Description of Artificial Sequence: Synthetic oligonucleotide
gggaggacgaugcgguuuucaauaucacuuuucgccagacgacucgcccga

SEQ ID NO: 14000 - RNA, 52 nt, Artificial Sequence
  Description of Artificial Sequence: Synthetic oligonucleotide
gggaggacgaugcggacuuuuuguuacuuuuuaccccagacgacucgcccga

SEQ ID NO: 14001 - RNA, 51 nt, Artificial Sequence
  Description of Artificial Sequence: Synthetic oligonucleotide
gggaggacgaugcgguuuaucuuuuaccuguuccccagacgacucgcccga

SEQ ID NO: 14002 - RNA, 51 nt, Artificial Sequence
  Description of Artificial Sequence: Synthetic oligonucleotide
gggaggacgaugcggauucucaauuuauuuccccgcagacgacucgcccga

SEQ ID NO: 14003 - RNA, 50 nt, Artificial Sequence
  Description of Artificial Sequence: Synthetic oligonucleotide
gggaggacgaugcggcuuucuuucucuuuuuccgcagacgacucgcccga

SEQ ID NO: 14004 - RNA, 50 nt, Artificial Sequence
  Description of Artificial Sequence: Synthetic oligonucleotide
gggaggacgaugcgguuuucuacuuucuuuuccgcagacgacucgcccga

SEQ ID NO: 14005 - RNA, 51 nt, Artificial Sequence
  Description of Artificial Sequence: Synthetic oligonucleotide
gggaggacgaugcgguuuucuauuauuccuuuccgcagacgacucgcccga

SEQ ID NO: 14006 - RNA, 51 nt, Artificial Sequence
  Description of Artificial Sequence: Synthetic oligonucleotide
gggaggacgaugcggcuuuauucuuuacuuuacugcagacgacucgcccga

SEQ ID NO: 14007 - RNA, 51 nt, Artificial Sequence
  Description of Artificial Sequence: Synthetic oligonucleotide
gggaggacgaugcgguuugguguuuucccgugccccagacgacucgcccga

SEQ ID NO: 14008 - RNA, 51 nt, Artificial Sequence
  Description of Artificial Sequence: Synthetic oligonucleotide
gggaggacgaugcggucucauguuccuccugugcccagacgacucgcccga

SEQ ID NO: 14009 - RNA, 51 nt, Artificial Sequence
  Description of Artificial Sequence: Synthetic oligonucleotide
gggaggacgaugcgguccuuucgucuuuucguccccagacgacucgcccga

SEQ ID NO: 14010 - RNA, 51 nt, Artificial Sequence
  Description of Artificial Sequence: Synthetic oligonucleotide
gggaggacgaugcgguccugucgucuuuguguccccagacgacucgcccga

SEQ ID NO: 14011 - RNA, 51 nt, Artificial Sequence
  Description of Artificial Sequence: Synthetic oligonucleotide
gggaggacgaugcgguccuugucgucuugcuuccccagacgacucgcccga

SEQ ID NO: 14012 - RNA, 51 nt, Artificial Sequence
  Description of Artificial Sequence: Synthetic oligonucleotide
gggaggacgaugcggauucuucuauuuucucuccgcagacgacucgcccga

SEQ ID NO: 14013 - RNA, 51 nt, Artificial Sequence
  Description of Artificial Sequence: Synthetic oligonucleotide
gggaggacgaugcgguccuugucgucuugccuccccagacgacucgcccga

SEQ ID NO: 14014 - RNA, 50 nt, Artificial Sequence
  Description of Artificial Sequence: Synthetic oligonucleotide
gggaggacgaugcggccuuucguucuacccuccccagacgacucgcccga

SEQ ID NO: 14015 - RNA, 51 nt, Artificial Sequence
  Description of Artificial Sequence: Synthetic oligonucleotide
gggaggacgaugcggaugcuuggaggagggaggugcagacgacucgcccga

SEQ ID NO: 14016 - RNA, 51 nt, Artificial Sequence
  Description of Artificial Sequence: Synthetic oligonucleotide
gggaggacgaugcgguccugucgucuuuacguccccagacgacucgcccga

SEQ ID NO: 14017 - RNA, 51 nt, Artificial Sequence
  Description of Artificial Sequence: Synthetic oligonucleotide
gggaggacgaugcggugagucguucccuucguucccagacgacucgcccga

SEQ ID NO: 14018 - RNA, 51 nt, Artificial Sequence
  Description of Artificial Sequence: Synthetic oligonucleotide
gggaggacgaugcggauacuucuaccuuuucuccgcagacgacucgcccga

SEQ ID NO: 14019 - RNA, 50 nt, Artificial Sequence
  Description of Artificial Sequence: Synthetic oligonucleotide
gggaggacgaugcggcguuucucugguucguccccagacgacucgcccga

SEQ ID NO: 14020 - RNA, 51 nt, Artificial Sequence
  Description of Artificial Sequence: Synthetic oligonucleotide
gggaggacgaugcgguccugucguccuuucguccccagacgacucgcccga

SEQ ID NO: 14021 - RNA, 50 nt, Artificial Sequence
  Description of Artificial Sequence: Synthetic oligonucleotide
gggaggacgaugcggguugguguaggggguuccgcagacgacucgcccga

SEQ ID NO: 14022 - RNA, 51 nt, Artificial Sequence
  Description of Artificial Sequence: Synthetic oligonucleotide
gggaggacgaugcgguuuccucuuguuuuuguccccagacgacucgcccga

SEQ ID NO: 14023 - RNA, 51 nt, Artificial Sequence
  Description of Artificial Sequence: Synthetic oligonucleotide
gggaggacgaugcggacuucuuaccuuuuucuccgcagacgacucgcccga

SEQ ID NO: 14024 - RNA, 51 nt, Artificial Sequence
  Description of Artificial Sequence: Synthetic oligonucleotide
gggaggacgaugcggggcuucucucuuuacuuccccagacgacucgcccga

SEQ ID NO: 14025 - RNA, 51 nt, Artificial Sequence
  Description of Artificial Sequence: Synthetic oligonucleotide
gggaggacgaugcggccuguuuauuuuuugccccccagacgacucgcccga

SEQ ID NO: 14026 - RNA, 51 nt, Artificial Sequence
  Description of Artificial Sequence: Synthetic oligonucleotide
gggaggacgaugcgguccagcuuucuuuuucuccgcagacgacucgcccga

SEQ ID NO: 14027 - RNA, 49 nt, Artificial Sequence
  Description of Artificial Sequence: Synthetic oligonucleotide
gggaggacgaugcggucuuuugcuuucuuuccgcagacgacucgcccga

SEQ ID NO: 14028 - RNA, 51 nt, Artificial Sequence
  Description of Artificial Sequence: Synthetic oligonucleotide
gggaggacgaugcggcuauuucuucuugcccuccgcagacgacucgcccga

SEQ ID NO: 14029 - RNA, 51 nt, Artificial Sequence
  Description of Artificial Sequence: Synthetic oligonucleotide
gggaggacgaugcgguuugaagggagauggguccucagacgacucgcccga

SEQ ID NO: 14030 - RNA, 51 nt, Artificial Sequence
  Description of Artificial Sequence: Synthetic oligonucleotide
gggaggacgaugcggcuuauggaguagggcggugccagacgacucgcccga

SEQ ID NO: 14031 - RNA, 51 nt, Artificial Sequence
  Description of Artificial Sequence: Synthetic oligonucleotide
gggaggacgaugcggaugcuuggaguagggaggggcagacgacucgcccga

SEQ ID NO: 14032 - RNA, 51 nt, Artificial Sequence
  Description of Artificial Sequence: Synthetic oligonucleotide
gggaggacgaugcggucaucuuugucuucuuuccgcagacgacucgcccga

SEQ ID NO: 14033 - RNA, 51 nt, Artificial Sequence
  Description of Artificial Sequence: Synthetic oligonucleotide
gggaggacgaugcggaguuucgucucuuuguuccgcagacgacucgcccga

SEQ ID NO: 14034 - RNA, 49 nt, Artificial Sequence
  Description of Artificial Sequence: Synthetic oligonucleotide
gggaggacgaugcgguucauuucuucuucuccgcagacgacucgcccga

SEQ ID NO: 14035 - RNA, 51 nt, Artificial Sequence
  Description of Artificial Sequence: Synthetic oligonucleotide
gggaggacgaugcggcuuuauccuuuucuccuccgcagacgacucgcccga

SEQ ID NO: 14036 - RNA, 50 nt, Artificial Sequence
  Description of Artificial Sequence: Synthetic oligonucleotide
gggaggacgaugcggccuuuuucuuuuucuaccgcagacgacucgcccga

SEQ ID NO: 14037 - RNA, 51 nt, Artificial Sequence
  Description of Artificial Sequence: Synthetic oligonucleotide
gggaggacgaugcggucuauucuucuuuucuccgccagacgacucgcccga

SEQ ID NO: 14038 - RNA, 52 nt, Artificial Sequence
  Description of Artificial Sequence: Synthetic oligonucleotide
gggaggacgaugcggauuuuucucuuuugcuugccgcagacgacucgcccga

SEQ ID NO: 14039 - RNA, 51 nt, Artificial Sequence
  Description of Artificial Sequence: Synthetic oligonucleotide
gggaggacgaugcggcuuuuuaaccaccuuuuccgcagacgacucgcccga

SEQ ID NO: 14040 - RNA, 51 nt, Artificial Sequence
  Description of Artificial Sequence: Synthetic oligonucleotide
gggaggacgaugcggguuacuuuccuuuccuaccgcagacgacucgcccga

SEQ ID NO: 14041 - RNA, 52 nt, Artificial Sequence
  Description of Artificial Sequence: Synthetic oligonucleotide
gggaggacgaugcgguaauuucuauuuuccgcuccgcagacgacucgcccga

SEQ ID NO: 14042 - RNA, 50 nt, Artificial Sequence
  Description of Artificial Sequence: Synthetic oligonucleotide
gggaggacgaugcggauucuuucucuuuucaccgcagacgacucgcccga

SEQ ID NO: 14043 - RNA, 50 nt, Artificial Sequence
  Description of Artificial Sequence: Synthetic oligonucleotide
gggaggacgaugcggucuuuuuguuucuuauccgcagacgacucgcccga

SEQ ID NO: 14044 - RNA, 51 nt, Artificial Sequence
  Description of Artificial Sequence: Synthetic oligonucleotide
gggaggacgaugcggcuuauggaguaggggggugccagacgacucgcccga

SEQ ID NO: 14045 - RNA, 51 nt, Artificial Sequence
  Description of Artificial Sequence: Synthetic oligonucleotide
gggaggacgaugcgggucgaagggugauggguccgcagacgacucgcccga

SEQ ID NO: 14046 - RNA, 51 nt, Artificial Sequence
  Description of Artificial Sequence: Synthetic oligonucleotide
gggaggacgaugcgguaugggaguaggguguuccgcagacgacucgcccga

SEQ ID NO: 14047 - RNA, 51 nt, Artificial Sequence
  Description of Artificial Sequence: Synthetic oligonucleotide
gggaggacgaugcgguuugaaggguuauggguccccagacgacucgcccga

SEQ ID NO: 14048 - RNA, 51 nt, Artificial Sequence
  Description of Artificial Sequence: Synthetic oligonucleotide
gggaggacgaugcgguuuccuuguuuuacugcccgcagacgacucgcccga

SEQ ID NO: 14049 - RNA, 51 nt, Artificial Sequence
  Description of Artificial Sequence: Synthetic oligonucleotide
gggaggacgaugcgguuauuucauuuccuucugcccagacgacucgcccga

SEQ ID NO: 14050 - RNA, 51 nt, Artificial Sequence
  Description of Artificial Sequence: Synthetic oligonucleotide
gggaggacgaugcggucuauuauccuucuuuuccgcagacgacucgcccga

SEQ ID NO: 14051 - RNA, 53 nt, Artificial Sequence
  Description of Artificial Sequence: Synthetic oligonucleotide
gggaggacgaugcggaaucuaccuuuuuuuuccuccgcagacgacucgcccga

SEQ ID NO: 14052 - RNA, 51 nt, Artificial Sequence
  Description of Artificial Sequence: Synthetic oligonucleotide
gggaggacgaugcgguucguuuaacucuuuuuccgcagacgacucgcccga

SEQ ID NO: 14053 - RNA, 51 nt, Artificial Sequence
  Description of Artificial Sequence: Synthetic oligonucleotide
gggaggacgaugcgguuucauaugcuuuuucccugcagacgacucgcccga

SEQ ID NO: 14054 - RNA, 51 nt, Artificial Sequence
  Description of Artificial Sequence: Synthetic oligonucleotide
gggaggacgaugcggauucgcucaucuuuuugccgcagacgacucgcccga

SEQ ID NO: 14055 - RNA, 51 nt, Artificial Sequence
  Description of Artificial Sequence: Synthetic oligonucleotide
gggaggacgaugcgguuccgcuauacuuucuuccgcagacgacucgcccga

SEQ ID NO: 14056 - RNA, 52 nt, Artificial Sequence
  Description of Artificial Sequence: Synthetic oligonucleotide
gggaggacgaugcgguguuaggucuuuuuuuuuccgcagacgacucgcccga

SEQ ID NO: 14057 - RNA, 51 nt, Artificial Sequence
  Description of Artificial Sequence: Synthetic oligonucleotide
gggaggacgaugcgguuuauuucuccuguuuuccccagacgacucgcccga

SEQ ID NO: 14058 - RNA, 51 nt, Artificial Sequence
  Description of Artificial Sequence: Synthetic oligonucleotide
gggaggacgaugcggaauccuuuuucuucuauccgcagacgacucgcccga

SEQ ID NO: 14059 - RNA, 51 nt, Artificial Sequence
  Description of Artificial Sequence: Synthetic oligonucleotide
gggaggacgaugcggaauuuuucgcuuuguuaccgcagacgacucgcccga

SEQ ID NO: 14060 - RNA, 51 nt, Artificial Sequence
  Description of Artificial Sequence: Synthetic oligonucleotide
gggaggacgaugcggucuuauuuaugccuuauccgcagacgacucgcccga

SEQ ID NO: 14061 - RNA, 51 nt, Artificial Sequence
  Description of Artificial Sequence: Synthetic oligonucleotide
gggaggacgaugcgguucgcuacauuuuuuauccccagacgacucgcccga

SEQ ID NO: 14062 - RNA, 51 nt, Artificial Sequence
  Description of Artificial Sequence: Synthetic oligonucleotide
gggaggacgaugcgguacauucuuauuuucuucgccagacgacucgcccga

SEQ ID NO: 14063 - RNA, 51 nt, Artificial Sequence
  Description of Artificial Sequence: Synthetic oligonucleotide
gggaggacgaugcggucuuuagcuuuucccauccgcagacgacucgcccga

SEQ ID NO: 14064 - RNA, 51 nt, Artificial Sequence
  Description of Artificial Sequence: Synthetic oligonucleotide
gggaggacgaugcgguuuccuuuuauuuuccccaccagacgacucgcccga

SEQ ID NO: 14065 - RNA, 51 nt, Artificial Sequence
  Description of Artificial Sequence: Synthetic oligonucleotide
gggaggacgaugcggauaucacuuuccuuucgccgcagacgacucgcccga

SEQ ID NO: 14066 - RNA, 51 nt, Artificial Sequence
  Description of Artificial Sequence: Synthetic oligonucleotide
gggaggacgaugcgguuucucuuuuccuuuguccgcagacgacucgcccga

SEQ ID NO: 14067 - RNA, 51 nt, Artificial Sequence
  Description of Artificial Sequence: Synthetic oligonucleotide
gggaggacgaugcggucccauuuugucuuuuuccgcagacgacucgcccga

SEQ ID NO: 14068 - RNA, 52 nt, Artificial Sequence
  Description of Artificial Sequence: Synthetic oligonucleotide
gggaggacgaugcgguuuuuuguuccauuuuauccgcagacgacucgcccga

SEQ ID NO: 14069 - RNA, 50 nt, Artificial Sequence
  Description of Artificial Sequence: Synthetic oligonucleotide
gggaggacgaugcggauauuuuguuuuuuugccccagacgacucgcccga

SEQ ID NO: 14070 - RNA, 51 nt, Artificial Sequence
  Description of Artificial Sequence: Synthetic oligonucleotide
gggaggacgaugcggcuuauauuucacuguuuccgcagacgacucgcccga

SEQ ID NO: 14071 - RNA, 51 nt, Artificial Sequence
  Description of Artificial Sequence: Synthetic oligonucleotide
gggaggacgaugcgguuuguuuuucucuuuuuccccagacgacucgcccga

SEQ ID NO: 14072 - RNA, 52 nt, Artificial Sequence
  Description of Artificial Sequence: Synthetic oligonucleotide
gggaggacgaugcggccauuuguuuuuuuuccuccgcagacgacucgcccga

SEQ ID NO: 14073 - RNA, 52 nt, Artificial Sequence
  Description of Artificial Sequence: Synthetic oligonucleotide
gggaggacgaugcgggaacucuuuuuuuuuucgccccagacgacucgcccga

SEQ ID NO: 14074 - RNA, 51 nt, Artificial Sequence
  Description of Artificial Sequence: Synthetic oligonucleotide
gggaggacgaugcggccauuuguuuuuuucuuccgcagacgacucgcccga

SEQ ID NO: 14075 - RNA, 50 nt, Artificial Sequence
  Description of Artificial Sequence: Synthetic oligonucleotide
gggaggacgaugcgguugaaggguguuggguccgcagacgacucgcccga

SEQ ID NO: 14076 - RNA, 51 nt, Artificial Sequence
  Description of Artificial Sequence: Synthetic oligonucleotide
gggaggacgaugcgguucacuaacauuucuuuccgcagacgacucgcccga

SEQ ID NO: 14077 - RNA, 51 nt, Artificial Sequence
  Description of Artificial Sequence: Synthetic oligonucleotide
gggaggacgaugcggcuuuuaaugaugcuuuuccgcagacgacucgcccga

SEQ ID NO: 14078 - RNA, 52 nt, Artificial Sequence
  Description of Artificial Sequence: Synthetic oligonucleotide
gggaggacgaugcggauuuuuuguauucuuuugccccagacgacucgcccga

SEQ ID NO: 14079 - RNA, 51 nt, Artificial Sequence
  Description of Artificial Sequence: Synthetic oligonucleotide
gggaggacgaugcggcguuguuaauguuuuuugcccagacgacucgcccga

SEQ ID NO: 14080 - RNA, 51 nt, Artificial Sequence
  Description of Artificial Sequence: Synthetic oligonucleotide
gggaggacgaugcggcuuucuucguuucuuucccgcagacgacucgcccga

SEQ ID NO: 14081 - RNA, 51 nt, Artificial Sequence
  Description of Artificial Sequence: Synthetic oligonucleotide
gggaggacgaugcggauauuucauucuuucuaccccagacgacucgcccga

SEQ ID NO: 14082 - RNA, 51 nt, Artificial Sequence
  Description of Artificial Sequence: Synthetic oligonucleotide
gggaggacgaugcggauuuucauguuucguucccgcagacgacucgcccga

SEQ ID NO: 14083 - RNA, 51 nt, Artificial Sequence
  Description of Artificial Sequence: Synthetic oligonucleotide
gggaggacgaugcggguuuuuuucuauuguuuccgcagacgacucgcccga

SEQ ID NO: 14084 - RNA, 51 nt, Artificial Sequence
  Description of Artificial Sequence: Synthetic oligonucleotide
gggaggacgaugcggcuuuuucuauucccauaccgcagacgacucgcccga

SEQ ID NO: 14085 - RNA, 51 nt, Artificial Sequence
  Description of Artificial Sequence: Synthetic oligonucleotide
gggaggacgaugcgguuuuugucucuuauuuccugcagacgacucgcccga

SEQ ID NO: 14086 - RNA, 51 nt, Artificial Sequence
  Description of Artificial Sequence: Synthetic oligonucleotide
gggaggacgaugcgguuuauucauuuucuugucgccagacgacucgcccga

SEQ ID NO: 14087 - RNA, 52 nt, Artificial Sequence
  Description of Artificial Sequence: Synthetic oligonucleotide
gggaggacgaugcggcacuuuuuuaucuuuaccccccagacgacucgcccga

SEQ ID NO: 14088 - RNA, 49 nt, Artificial Sequence
  Description of Artificial Sequence: Synthetic oligonucleotide
gggaggacgaugcgguuuuucuucuuuuuuccgcagacgacucgcccga

SEQ ID NO: 14089 - RNA, 51 nt, Artificial Sequence
  Description of Artificial Sequence: Synthetic oligonucleotide
gggaggacgaugcggaucuugguuuuuauuucccgcagacgacucgcccga

SEQ ID NO: 14090 - RNA, 51 nt, Artificial Sequence
  Description of Artificial Sequence: Synthetic oligonucleotide
gggaggacgaugcggcaucuacucuuuacucuccgcagacgacucgcccga

SEQ ID NO: 14091 - RNA, 51 nt, Artificial Sequence
  Description of Artificial Sequence: Synthetic oligonucleotide
gggaggacgaugcggacuucguuucacuuucaccgcagacgacucgcccga

SEQ ID NO: 14092 - RNA, 51 nt, Artificial Sequence
  Description of Artificial Sequence: Synthetic oligonucleotide
gggaggacgaugcgguuuucuaccagcuuucuccgcagacgacucgcccga

SEQ ID NO: 14093 - RNA, 51 nt, Artificial Sequence
  Description of Artificial Sequence: Synthetic oligonucleotide
gggaggacgaugcgguucacuucuuucuuuuucgccagacgacucgcccga

SEQ ID NO: 14094 - RNA, 51 nt, Artificial Sequence
  Description of Artificial Sequence: Synthetic oligonucleotide
gggaggacgaugcggcauuuucuacuuuuuuuccgcagacgacucgcccga

SEQ ID NO: 14095 - RNA, 51 nt, Artificial Sequence
  Description of Artificial Sequence: Synthetic oligonucleotide
gggaggacgaugcggcucuuugcuucuuuaucccgcagacgacucgcccga

SEQ ID NO: 14096 - RNA, 53 nt, Artificial Sequence
  Description of Artificial Sequence: Synthetic oligonucleotide
gggaggacgaugcgguauuucacuguuuuuuuugcugcagacgacucgcccga

SEQ ID NO: 14097 - RNA, 51 nt, Artificial Sequence
  Description of Artificial Sequence: Synthetic oligonucleotide
gggaggacgaugcgguuuuucguguuuuuaccccgcagacgacucgcccga

SEQ ID NO: 14098 - RNA, 51 nt, Artificial Sequence
  Description of Artificial Sequence: Synthetic oligonucleotide
gggaggacgaugcgguuauuguuucauuuugugugcagacgacucgcccga

SEQ ID NO: 14099 - RNA, 51 nt, Artificial Sequence
  Description of Artificial Sequence: Synthetic oligonucleotide
gggaggacgaugcggcuuauuuaucuuucucuccgcagacgacucgcccga

SEQ ID NO: 14100 - RNA, 52 nt, Artificial Sequence
  Description of Artificial Sequence: Synthetic oligonucleotide
gggaggacgaugcgguuugcuuuuuuuuuccuugcccagacgacucgcccga

SEQ ID NO: 14101 - RNA, 50 nt, Artificial Sequence
  Description of Artificial Sequence: Synthetic oligonucleotide
gggaggacgaugcggauuauugcuuuuuuugcugcagacgacucgcccga

SEQ ID NO: 14102 - RNA, 51 nt, Artificial Sequence
  Description of Artificial Sequence: Synthetic oligonucleotide
gggaggacgaugcggcucuuuaccuuuuauucccgcagacgacucgcccga

SEQ ID NO: 14103 - RNA, 51 nt, Artificial Sequence
  Description of Artificial Sequence: Synthetic oligonucleotide
gggaggacgaugcgguacuuuuguuucuuuuucugcagacgacucgcccga

SEQ ID NO: 14104 - RNA, 51 nt, Artificial Sequence
  Description of Artificial Sequence: Synthetic oligonucleotide
gggaggacgaugcggcuuuauccugcaagccuguacagacgacucgcccga

SEQ ID NO: 14105 - RNA, 51 nt, Artificial Sequence
  Description of Artificial Sequence: Synthetic oligonucleotide
gggaggacgaugcggguuauucauuacuuuugccgcagacgacucgcccga

SEQ ID NO: 14106 - RNA, 51 nt, Artificial Sequence
  Description of Artificial Sequence: Synthetic oligonucleotide
gggaggacgaugcggauauuucuaacuuuuuacugcagacgacucgcccga

SEQ ID NO: 14107 - RNA, 51 nt, Artificial Sequence
  Description of Artificial Sequence: Synthetic oligonucleotide
gggaggacgaugcgggcccuucguucugcucuccccagacgacucgcccga

SEQ ID NO: 14108 - RNA, 51 nt, Artificial Sequence
  Description of Artificial Sequence: Synthetic oligonucleotide
gggaggacgaugcgguuugaagggcgauggguccucagacgacucgcccga

SEQ ID NO: 14109 - RNA, 51 nt, Artificial Sequence
  Description of Artificial Sequence: Synthetic oligonucleotide
gggaggacgaugcgguuuucuuucuuuauuugccgcagacgacucgcccga

SEQ ID NO: 14110 - RNA, 50 nt, Artificial Sequence
  Description of Artificial Sequence: Synthetic oligonucleotide
gggaggacgaugcggauuuucauuuuuuccgccgcagacgacucgcccga

SEQ ID NO: 14111 - RNA, 51 nt, Artificial Sequence
  Description of Artificial Sequence: Synthetic oligonucleotide
gggaggacgaugcggucuuuuucucuaucucuccgcagacgacucgcccga

SEQ ID NO: 14112 - RNA, 52 nt, Artificial Sequence
  Description of Artificial Sequence: Synthetic oligonucleotide
gggaggacgaugcggacuuuuuuuucuuuucuaccgcagacgacucgcccga

SEQ ID NO: 14113 - RNA, 51 nt, Artificial Sequence
  Description of Artificial Sequence: Synthetic oligonucleotide
gggaggacgaugcgguuuuuuguuucuuucccccgcagacgacucgcccga

SEQ ID NO: 14114 - RNA, 51 nt, Artificial Sequence
  Description of Artificial Sequence: Synthetic oligonucleotide
gggaggacgaugcggccuuuuugcuuccuuugcugcagacgacucgcccga

SEQ ID NO: 14115 - RNA, 51 nt, Artificial Sequence
  Description of Artificial Sequence: Synthetic oligonucleotide
gggaggacgaugcggcuuuuauauccucugcuccgcagacgacucgcccga

SEQ ID NO: 14116 - RNA, 53 nt, Artificial Sequence
  Description of Artificial Sequence: Synthetic oligonucleotide
gggaggacgaugcggaauauuacuuuuuuuuuccccgcagacgacucgcccga

SEQ ID NO: 14117 - RNA, 51 nt, Artificial Sequence
  Description of Artificial Sequence: Synthetic oligonucleotide
gggaggacgaugcggcuuacacuucauauuuuccgcagacgacucgcccga

SEQ ID NO: 14118 - RNA, 49 nt, Artificial Sequence
  Description of Artificial Sequence: Synthetic oligonucleotide
gggaggacgaugcgguuucuuucauuuuuuccgcagacgacucgcccga

SEQ ID NO: 14119 - RNA, 52 nt, Artificial Sequence
  Description of Artificial Sequence: Synthetic oligonucleotide
gggaggacgaugcgguuuuccguuccuuuuuuuccgcagacgacucgcccga

SEQ ID NO: 14120 - RNA, 50 nt, Artificial Sequence
  Description of Artificial Sequence: Synthetic oligonucleotide
gggaggacgaugcggcuuuugcucuuuuucuccgcagacgacucgcccga

SEQ ID NO: 14121 - RNA, 53 nt, Artificial Sequence
  Description of Artificial Sequence: Synthetic oligonucleotide
gggaggacgaugcgguuuuacuuguuuuuuuuguccgcagacgacucgcccga

SEQ ID NO: 14122 - RNA, 51 nt, Artificial Sequence
  Description of Artificial Sequence: Synthetic oligonucleotide
gggaggacgaugcggauuccacuuuuuuuucgccgcagacgacucgcccga

SEQ ID NO: 14123 - RNA, 50 nt, Artificial Sequence
  Description of Artificial Sequence: Synthetic oligonucleotide
gggaggacgaugcggaucuuuauuuuucucuccgcagacgacucgcccga

SEQ ID NO: 14124 - RNA, 51 nt, Artificial Sequence
  Description of Artificial Sequence: Synthetic oligonucleotide
gggaggacgaugcggguugguguaggggggcuccgcagacgacucgcccga

SEQ ID NO: 14125 - RNA, 50 nt, Artificial Sequence
  Description of Artificial Sequence: Synthetic oligonucleotide
gggaggacgaugcgguuuucuuucuauucuuccgcagacgacucgcccga

SEQ ID NO: 14126 - RNA, 53 nt, Artificial Sequence
  Description of Artificial Sequence: Synthetic oligonucleotide
gggaggacgaugcgguuuugccauguuuuuuuuaccgcagacgacucgcccga

SEQ ID NO: 14127 - RNA, 51 nt, Artificial Sequence
  Description of Artificial Sequence: Synthetic oligonucleotide
gggaggacgaugcgguuuuaacuuuuuccuuugcacagacgacucgcccga

SEQ ID NO: 14128 - RNA, 51 nt, Artificial Sequence
  Description of Artificial Sequence: Synthetic oligonucleotide
gggaggacgaugcggccuuuuuauuucauuuuccgcagacgacucgcccga

SEQ ID NO: 14129 - RNA, 51 nt, Artificial Sequence
  Description of Artificial Sequence: Synthetic oligonucleotide
gggaggacgaugcgguuuauuuucgauuuucugcccagacgacucgcccga

SEQ ID NO: 14130 - RNA, 51 nt, Artificial Sequence
  Description of Artificial Sequence: Synthetic oligonucleotide
gggaggacgaugcgguccuuuaucuuguuuuuccgcagacgacucgcccga

SEQ ID NO: 14131 - RNA, 50 nt, Artificial Sequence
  Description of Artificial Sequence: Synthetic oligonucleotide
gggaggacgaugcgguuuuucuaauuacguuccgcagacgacucgcccga

SEQ ID NO: 14132 - RNA, 51 nt, Artificial Sequence
  Description of Artificial Sequence: Synthetic oligonucleotide
gggaggacgaugcgguuauucucuuuuuuuguguccagacgacucgcccga

SEQ ID NO: 14133 - RNA, 51 nt, Artificial Sequence
  Description of Artificial Sequence: Synthetic oligonucleotide
gggaggacgaugcggcuuuuuugguuuucuuuccgcagacgacucgcccga

SEQ ID NO: 14134 - RNA, 51 nt, Artificial Sequence
  Description of Artificial Sequence: Synthetic oligonucleotide
gggaggacgaugcgguuuggguucuuuuuuuucugcagacgacucgcccga

SEQ ID NO: 14135 - RNA, 51 nt, Artificial Sequence
  Description of Artificial Sequence: Synthetic oligonucleotide
gggaggacgaugcggguuucgccuguuuucuuccgcagacgacucgcccga

SEQ ID NO: 14136 - RNA, 51 nt, Artificial Sequence
  Description of Artificial Sequence: Synthetic oligonucleotide
gggaggacgaugcggguuuuauuuauucguuuccgcagacgacucgcccga

SEQ ID NO: 14137 - RNA, 51 nt, Artificial Sequence
  Description of Artificial Sequence: Synthetic oligonucleotide
gggaggacgaugcgguacuauucuucuuuuugccgcagacgacucgcccga

SEQ ID NO: 14138 - RNA, 50 nt, Artificial Sequence
  Description of Artificial Sequence: Synthetic oligonucleotide
gggaggacgaugcgguuucuuuacuuucuuuccgcagacgacucgcccga

SEQ ID NO: 14139 - RNA, 51 nt, Artificial Sequence
  Description of Artificial Sequence: Synthetic oligonucleotide
gggaggacgaugcggccuuuuaacguuucgcuccgcagacgacucgcccga

SEQ ID NO: 14140 - RNA, 52 nt, Artificial Sequence
  Description of Artificial Sequence: Synthetic oligonucleotide
gggaggacgaugcgguuuuagcuuuuuuuuuguccgcagacgacucgcccga

SEQ ID NO: 14141 - RNA, 51 nt, Artificial Sequence
  Description of Artificial Sequence: Synthetic oligonucleotide
gggaggacgaugcgguuuuuaccuuuuucguuccgcagacgacucgcccga

SEQ ID NO: 14142 - RNA, 53 nt, Artificial Sequence
  Description of Artificial Sequence: Synthetic oligonucleotide
gggaggacgaugcggucuuuuuuuucuucuacccccgcagacgacucgcccga

SEQ ID NO: 14143 - RNA, 51 nt, Artificial Sequence
  Description of Artificial Sequence: Synthetic oligonucleotide
gggaggacgaugcggucuuuuaacguguuuucccgcagacgacucgcccga

SEQ ID NO: 14144 - RNA, 51 nt, Artificial Sequence
  Description of Artificial Sequence: Synthetic oligonucleotide
gggaggacgaugcggguuucuucuuuauuacuccccagacgacucgcccga

SEQ ID NO: 14145 - RNA, 52 nt, Artificial Sequence
  Description of Artificial Sequence: Synthetic oligonucleotide
gggaggacgaugcgguucuuuauuuuuuucccuccucagacgacucgcccga

SEQ ID NO: 14146 - RNA, 51 nt, Artificial Sequence
  Description of Artificial Sequence: Synthetic oligonucleotide
gggaggacgaugcgguuugggguuuuccagugccccagacgacucgcccga

SEQ ID NO: 14147 - RNA, 51 nt, Artificial Sequence
  Description of Artificial Sequence: Synthetic oligonucleotide
gggaggacgaugcggcccugucgucuuugcguccccagacgacucgcccga

SEQ ID NO: 14148 - RNA, 51 nt, Artificial Sequence
  Description of Artificial Sequence: Synthetic oligonucleotide
gggaggacgaugcgguccuuaucgucuugcguccccagacgacucgcccga

SEQ ID NO: 14149 - RNA, 51 nt, Artificial Sequence
  Description of Artificial Sequence: Synthetic oligonucleotide
gggaggacgaugcgguccugacgucugugcguccccagacgacucgcccga

SEQ ID NO: 14150 - RNA, 49 nt, Artificial Sequence
  Description of Artificial Sequence: Synthetic oligonucleotide
gggaggacgaugcggcuuugcucuuuuucuccgcagacgacucgcccga

SEQ ID NO: 14151 - RNA, 51 nt, Artificial Sequence
  Description of Artificial Sequence: Synthetic oligonucleotide
gggaggacgaugcggugagucguucucuucguccccagacgacucgcccga

SEQ ID NO: 14152 - RNA, 51 nt, Artificial Sequence
  Description of Artificial Sequence: Synthetic oligonucleotide
gggaggacgaugcgguuuauuucuuccacguuccgcagacgacucgcccga

SEQ ID NO: 14153 - RNA, 51 nt, Artificial Sequence
  Description of Artificial Sequence: Synthetic oligonucleotide
gggaggacgaugcggaucuuuauuuuuucccuccgcagacgacucgcccga

SEQ ID NO: 14154 - RNA, 51 nt, Artificial Sequence
  Description of Artificial Sequence: Synthetic oligonucleotide
gggaggacgaugcgguaccuuauccugcagguccccagacgacucgcccga

SEQ ID NO: 14155 - RNA, 52 nt, Artificial Sequence
  Description of Artificial Sequence: Synthetic oligonucleotide
gggaggacgaugcggguccugucgucuguuuguccccagacgacucgcccga

SEQ ID NO: 14156 - RNA, 51 nt, Artificial Sequence
  Description of Artificial Sequence: Synthetic oligonucleotide
gggaggacgaugcgguccuggcuuguuguuguccccagacgacucgcccga

SEQ ID NO: 14157 - RNA, 49 nt, Artificial Sequence
  Description of Artificial Sequence: Synthetic oligonucleotide
gggaggacgaugcgguuuacuuuccucuugccgcagacgacucgcccga

SEQ ID NO: 14158 - RNA, 51 nt, Artificial Sequence
  Description of Artificial Sequence: Synthetic oligonucleotide
gggaggacgaugcgguuugggagaaggggguuccgcagacgacucgcccga

SEQ ID NO: 14159 - RNA, 51 nt, Artificial Sequence
  Description of Artificial Sequence: Synthetic oligonucleotide
gggaggacgaugcgguuacccuuacuuuugcuccgcagacgacucgcccga

SEQ ID NO: 14160 - RNA, 50 nt, Artificial Sequence
  Description of Artificial Sequence: Synthetic oligonucleotide
gggaggacgaugcggauuuuuccuguuuuugccgcagacgacucgcccga

SEQ ID NO: 14161 - RNA, 51 nt, Artificial Sequence
  Description of Artificial Sequence: Synthetic oligonucleotide
gggaggacgaugcggaugcuuggaguauggaggugcagacgacucgcccga

SEQ ID NO: 14162 - RNA, 51 nt, Artificial Sequence
  Description of Artificial Sequence: Synthetic oligonucleotide
gggaggacgaugcgguuugaagggugauguuuccgcagacgacucgcccga

SEQ ID NO: 14163 - RNA, 51 nt, Artificial Sequence
  Description of Artificial Sequence: Synthetic oligonucleotide
gggaggacgaugcgguccugucgucugguuguccccagacgacucgcccga

SEQ ID NO: 14164 - RNA, 51 nt, Artificial Sequence
  Description of Artificial Sequence: Synthetic oligonucleotide
gggaggacgaugcggaucuuuucuuuccucugccgcagacgacucgcccga

SEQ ID NO: 14165 - RNA, 51 nt, Artificial Sequence
  Description of Artificial Sequence: Synthetic oligonucleotide
gggaggacgaugcgguuuuugcucuuuucccuccgcagacgacucgcccga

SEQ ID NO: 14166 - RNA, 51 nt, Artificial Sequence
  Description of Artificial Sequence: Synthetic oligonucleotide
gggaggacgaugcggucuuuucguucugcccuccccagacgacucgcccga

SEQ ID NO: 14167 - RNA, 50 nt, Artificial Sequence
  Description of Artificial Sequence: Synthetic oligonucleotide
gggaggacgaugcggucuuuguuauuuucauccgcagacgacucgcccga

SEQ ID NO: 14168 - RNA, 51 nt, Artificial Sequence
  Description of Artificial Sequence: Synthetic oligonucleotide
gggaggacgaugcgguguuuuuuacucuuuugcgccagacgacucgcccga

SEQ ID NO: 14169 - RNA, 51 nt, Artificial Sequence
  Description of Artificial Sequence: Synthetic oligonucleotide
gggaggacgaugcggaccauucuuaucuccuuccgcagacgacucgcccga

SEQ ID NO: 14170 - RNA, 51 nt, Artificial Sequence
  Description of Artificial Sequence: Synthetic oligonucleotide
gggaggacgaugcggaauuacuuacuuuuuacccccagacgacucgcccga

SEQ ID NO: 14171 - RNA, 52 nt, Artificial Sequence
  Description of Artificial Sequence: Synthetic oligonucleotide
gggaggacgaugcggauucuuuuguuuuuuuucccgcagacgacucgcccga

SEQ ID NO: 14172 - RNA, 51 nt, Artificial Sequence
  Description of Artificial Sequence: Synthetic oligonucleotide
gggaggacgaugcggccuuucuuauucuaccuccgcagacgacucgcccga

SEQ ID NO: 14173 - RNA, 51 nt, Artificial Sequence
  Description of Artificial Sequence: Synthetic oligonucleotide
gggaggacgaugcggguauugcuuucuuuuugccccagacgacucgcccga

SEQ ID NO: 14174 - RNA, 51 nt, Artificial Sequence
  Description of Artificial Sequence: Synthetic oligonucleotide
gggaggacgaugcgguacuuucuuuccaccuuccgcagacgacucgcccga

SEQ ID NO: 14175 - RNA, 52 nt, Artificial Sequence
  Description of Artificial Sequence: Synthetic oligonucleotide
gggaggacgaugcggauuucucuuuuuuucgucccgcagacgacucgcccga

SEQ ID NO: 14176 - RNA, 51 nt, Artificial Sequence
  Description of Artificial Sequence: Synthetic oligonucleotide
gggaggacgaugcggguuuauagccucuuuuuccgcagacgacucgcccga

SEQ ID NO: 14177 - RNA, 50 nt, Artificial Sequence
  Description of Artificial Sequence: Synthetic oligonucleotide
gggaggacgaugcgguuuccuuuuuucccauccgcagacgacucgcccga

SEQ ID NO: 14178 - RNA, 53 nt, Artificial Sequence
  Description of Artificial Sequence: Synthetic oligonucleotide
gggaggacgaugcgggccuuuuucguucugcccuccccagacgacucgcccga

SEQ ID NO: 14179 - RNA, 52 nt, Artificial Sequence
  Description of Artificial Sequence: Synthetic oligonucleotide
gggaggacgaugcggcuccuuguugcuuuuucuccgcagacgacucgcccga

SEQ ID NO: 14180 - RNA, 51 nt, Artificial Sequence
  Description of Artificial Sequence: Synthetic oligonucleotide
gggaggacgaugcgguuaucacuuuuccuuguccccagacgacucgcccga

SEQ ID NO: 14181 - RNA, 53 nt, Artificial Sequence
  Description of Artificial Sequence: Synthetic oligonucleotide
gggaggacgaugcggcuuucacuuuuuuuccucuccgcagacgacucgcccga

SEQ ID NO: 14182 - RNA, 50 nt, Artificial Sequence
  Description of Artificial Sequence: Synthetic oligonucleotide
gggaggacgaugcggauuacucuucucuuugccgcagacgacucgcccga

SEQ ID NO: 14183 - RNA, 51 nt, Artificial Sequence
  Description of Artificial Sequence: Synthetic oligonucleotide
gggaggacgaugcggccuuuuaccuuuuuucuccgcagacgacucgcccga

SEQ ID NO: 14184 - RNA, 51 nt, Artificial Sequence
  Description of Artificial Sequence: Synthetic oligonucleotide
gggaggacgaugcgguuucuuuuuauuccuguccgcagacgacucgcccga

SEQ ID NO: 14185 - RNA, 51 nt, Artificial Sequence
  Description of Artificial Sequence: Synthetic oligonucleotide
gggaggacgaugcggauucacuucuuuucuuuccgcagacgacucgcccga

SEQ ID NO: 14186 - RNA, 52 nt, Artificial Sequence
  Description of Artificial Sequence: Synthetic oligonucleotide
gggaggacgaugcggucuuuucauguuuucucuccgcagacgacucgcccga

SEQ ID NO: 14187 - RNA, 51 nt, Artificial Sequence
  Description of Artificial Sequence: Synthetic oligonucleotide
gggaggacgaugcggguucacucuuuccauucccccagacgacucgcccga

SEQ ID NO: 14188 - RNA, 52 nt, Artificial Sequence
  Description of Artificial Sequence: Synthetic oligonucleotide
gggaggacgaugcggaguuuuuugucuuuuuucccccagacgacucgcccga

SEQ ID NO: 14189 - RNA, 51 nt, Artificial Sequence
  Description of Artificial Sequence: Synthetic oligonucleotide
gggaggacgaugcggcuuaccguuuucuucuuccgcagacgacucgcccga

SEQ ID NO: 14190 - RNA, 51 nt, Artificial Sequence
  Description of Artificial Sequence: Synthetic oligonucleotide
gggaggacgaugcggcucuauuauccucuucuccgcagacgacucgcccga

SEQ ID NO: 14191 - RNA, 51 nt, Artificial Sequence
  Description of Artificial Sequence: Synthetic oligonucleotide
gggaggacgaugcggguuuguuucuuuaguuuccccagacgacucgcccga

SEQ ID NO: 14192 - RNA, 52 nt, Artificial Sequence
  Description of Artificial Sequence: Synthetic oligonucleotide
gggaggacgaugcggcuuuuuuuguucuuucauccgcagacgacucgcccga

SEQ ID NO: 14193 - RNA, 51 nt, Artificial Sequence
  Description of Artificial Sequence: Synthetic oligonucleotide
gggaggacgaugcgguauugcuuguauuuccuccgcagacgacucgcccga

SEQ ID NO: 14194 - RNA, 51 nt, Artificial Sequence
  Description of Artificial Sequence: Synthetic oligonucleotide
gggaggacgaugcggucuaccuuuacuucuucccgcagacgacucgcccga

SEQ ID NO: 14195 - RNA, 50 nt, Artificial Sequence
  Description of Artificial Sequence: Synthetic oligonucleotide
gggaggacgaugcgggcuuuucguucugccuccccagacgacucgcccga

SEQ ID NO: 14196 - RNA, 51 nt, Artificial Sequence
  Description of Artificial Sequence: Synthetic oligonucleotide
gggaggacgaugcgggccucucguucugcucuccccagacgacucgcccga

SEQ ID NO: 14197 - RNA, 51 nt, Artificial Sequence
  Description of Artificial Sequence: Synthetic oligonucleotide
gggaggacgaugcggcuucuuuuaucucucuuccgcagacgacucgcccga

SEQ ID NO: 14198 - RNA, 51 nt, Artificial Sequence
  Description of Artificial Sequence: Synthetic oligonucleotide
gggaggacgaugcggcauuucaccuuacuuuuccgcagacgacucgcccga

SEQ ID NO: 14199 - RNA, 50 nt, Artificial Sequence
  Description of Artificial Sequence: Synthetic oligonucleotide
gggaggacgaugcggaucuucuuauuuucugccgcagacgacucgcccga

SEQ ID NO: 14200 - RNA, 51 nt, Artificial Sequence
  Description of Artificial Sequence: Synthetic oligonucleotide
gggaggacgaugcggcuuucauuguucuuuugccccagacgacucgcccga

SEQ ID NO: 14201 - RNA, 52 nt, Artificial Sequence
  Description of Artificial Sequence: Synthetic oligonucleotide
gggaggacgaugcgguuuguauuccccuuuuuuccgcagacgacucgcccga

SEQ ID NO: 14202 - RNA, 50 nt, Artificial Sequence
  Description of Artificial Sequence: Synthetic oligonucleotide
gggaggacgaugcgguuuucuuuuccuuuguccgcagacgacucgcccga

SEQ ID NO: 14203 - RNA, 51 nt, Artificial Sequence
  Description of Artificial Sequence: Synthetic oligonucleotide
gggaggacgaugcggguuggaguagggggguuccgcagacgacucgcccga

SEQ ID NO: 14204 - RNA, 52 nt, Artificial Sequence
  Description of Artificial Sequence: Synthetic oligonucleotide
gggaggacgaugcggauuuucucuuuuuuuuugccgcagacgacucgcccga

SEQ ID NO: 14205 - RNA, 51 nt, Artificial Sequence
  Description of Artificial Sequence: Synthetic oligonucleotide
gggaggacgaugcggucacuuuucuuuucuuaccccagacgacucgcccga

SEQ ID NO: 14206 - RNA, 51 nt, Artificial Sequence
  Description of Artificial Sequence: Synthetic oligonucleotide
gggaggacgaugcgguuuguagggugaugggaccgcagacgacucgcccga

SEQ ID NO: 14207 - RNA, 51 nt, Artificial Sequence
  Description of Artificial Sequence: Synthetic oligonucleotide
gggaggacgaugcggauauccucuuuuuucugccgcagacgacucgcccga

SEQ ID NO: 14208 - RNA, 51 nt, Artificial Sequence
  Description of Artificial Sequence: Synthetic oligonucleotide
gggaggacgaugcgguuauuccuuuuucuugccgccagacgacucgcccga

SEQ ID NO: 14209 - RNA, 51 nt, Artificial Sequence
  Description of Artificial Sequence: Synthetic oligonucleotide
gggaggacgaugcggguugguguagggguguuccgcagacgacucgcccga

SEQ ID NO: 14210 - RNA, 51 nt, Artificial Sequence
  Description of Artificial Sequence: Synthetic oligonucleotide
gggaggacgaugcgguuugaagggguauggguccgcagacgacucgcccga

SEQ ID NO: 14211 - RNA, 52 nt, Artificial Sequence
  Description of Artificial Sequence: Synthetic oligonucleotide
gggaggacgaugcggguuuuuguugguuuuuuuccgcagacgacucgcccga

SEQ ID NO: 14212 - RNA, 51 nt, Artificial Sequence
  Description of Artificial Sequence: Synthetic oligonucleotide
gggaggacgaugcgguuuuauaucuuccuuuugcccagacgacucgcccga

SEQ ID NO: 14213 - RNA, 52 nt, Artificial Sequence
  Description of Artificial Sequence: Synthetic oligonucleotide
gggaggacgaugcggccuuuuuuauuccuuuugccgcagacgacucgcccga

SEQ ID NO: 14214 - RNA, 52 nt, Artificial Sequence
  Description of Artificial Sequence: Synthetic oligonucleotide
gggaggacgaugcgguuuugaagggugaugggcccgcagacgacucgcccga

SEQ ID NO: 14215 - RNA, 52 nt, Artificial Sequence
  Description of Artificial Sequence: Synthetic oligonucleotide
gggaggacgaugcgguuuuuuuccuuucacuauccgcagacgacucgcccga

SEQ ID NO: 14216 - RNA, 51 nt, Artificial Sequence
  Description of Artificial Sequence: Synthetic oligonucleotide
gggaggacgaugcggucauucuuuucuucuuacgccagacgacucgcccga

SEQ ID NO: 14217 - RNA, 51 nt, Artificial Sequence
  Description of Artificial Sequence: Synthetic oligonucleotide
gggaggacgaugcggucuuauacugauggccgcgucagacgacucgcccga

SEQ ID NO: 14218 - RNA, 51 nt, Artificial Sequence
  Description of Artificial Sequence: Synthetic oligonucleotide
gggaggacgaugcggucuuuauuuguacucuccugcagacgacucgcccga

SEQ ID NO: 14219 - RNA, 51 nt, Artificial Sequence
  Description of Artificial Sequence: Synthetic oligonucleotide
gggaggacgaugcgguucguuuuugcauuucuccgcagacgacucgcccga

SEQ ID NO: 14220 - RNA, 51 nt, Artificial Sequence
  Description of Artificial Sequence: Synthetic oligonucleotide
gggaggacgaugcgguguuguuuucguguuuuccgcagacgacucgcccga

SEQ ID NO: 14221 - RNA, 52 nt, Artificial Sequence
  Description of Artificial Sequence: Synthetic oligonucleotide
gggaggacgaugcggauuccacuuuuuuuuucgccgcagacgacucgcccga

SEQ ID NO: 14222 - RNA, 51 nt, Artificial Sequence
  Description of Artificial Sequence: Synthetic oligonucleotide
gggaggacgaugcggaauuucuuuucuacccgccgcagacgacucgcccga

SEQ ID NO: 14223 - RNA, 51 nt, Artificial Sequence
  Description of Artificial Sequence: Synthetic oligonucleotide
gggaggacgaugcggacuguuuuuaucauuuugcccagacgacucgcccga

SEQ ID NO: 14224 - RNA, 51 nt, Artificial Sequence
  Description of Artificial Sequence: Synthetic oligonucleotide
gggaggacgaugcgguauuuuaauucuccuuugcccagacgacucgcccga

SEQ ID NO: 14225 - RNA, 51 nt, Artificial Sequence
  Description of Artificial Sequence: Synthetic oligonucleotide
gggaggacgaugcggcucuuuuuuuuguuuccccgcagacgacucgcccga

SEQ ID NO: 14226 - RNA, 50 nt, Artificial Sequence
  Description of Artificial Sequence: Synthetic oligonucleotide
gggaggacgaugcggugcuuugguuuuuuuuccgcagacgacucgcccga

SEQ ID NO: 14227 - RNA, 51 nt, Artificial Sequence
  Description of Artificial Sequence: Synthetic oligonucleotide
gggaggacgaugcggugugcuugauuauuuuuccgcagacgacucgcccga

SEQ ID NO: 14228 - RNA, 50 nt, Artificial Sequence
  Description of Artificial Sequence: Synthetic oligonucleotide
gggaggacgaugcgguuuuuguuuuuuuuacccgcagacgacucgcccga

SEQ ID NO: 14229 - RNA, 51 nt, Artificial Sequence
  Description of Artificial Sequence: Synthetic oligonucleotide
gggaggacgaugcggcuuuucuucuuuuccuuccgcagacgacucgcccga

SEQ ID NO: 14230 - RNA, 51 nt, Artificial Sequence
  Description of Artificial Sequence: Synthetic oligonucleotide
gggaggacgaugcgguuuuuuauaucauguucccgcagacgacucgcccga

SEQ ID NO: 14231 - RNA, 51 nt, Artificial Sequence
  Description of Artificial Sequence: Synthetic oligonucleotide
gggaggacgaugcggcuuuucauucucuucguugccagacgacucgcccga

SEQ ID NO: 14232 - RNA, 51 nt, Artificial Sequence
  Description of Artificial Sequence: Synthetic oligonucleotide
gggaggacgaugcggccuguuuucuuguuauuccgcagacgacucgcccga

SEQ ID NO: 14233 - RNA, 51 nt, Artificial Sequence
  Description of Artificial Sequence: Synthetic oligonucleotide
gggaggacgaugcggcuuauucuuacuuuacuccgcagacgacucgcccga

SEQ ID NO: 14234 - RNA, 51 nt, Artificial Sequence
  Description of Artificial Sequence: Synthetic oligonucleotide
gggaggacgaugcgggccuuaucuuuuuuacuccgcagacgacucgcccga

SEQ ID NO: 14235 - RNA, 51 nt, Artificial Sequence
  Description of Artificial Sequence: Synthetic oligonucleotide
gggaggacgaugcggcuuuguuuuauucuuguugccagacgacucgcccga

SEQ ID NO: 14236 - RNA, 51 nt, Artificial Sequence
  Description of Artificial Sequence: Synthetic oligonucleotide
gggaggacgaugcggcuuugucuuuuauucucccgcagacgacucgcccga

SEQ ID NO: 14237 - RNA, 51 nt, Artificial Sequence
  Description of Artificial Sequence: Synthetic oligonucleotide
gggaggacgaugcggucucuuuagcauuuuuuccgcagacgacucgcccga

SEQ ID NO: 14238 - RNA, 51 nt, Artificial Sequence
  Description of Artificial Sequence: Synthetic oligonucleotide
gggaggacgaugcggugucuauuuauuuccuuccgcagacgacucgcccga

SEQ ID NO: 14239 - RNA, 51 nt, Artificial Sequence
  Description of Artificial Sequence: Synthetic oligonucleotide
gggaggacgaugcgguuuucauccugucuuguccgcagacgacucgcccga

SEQ ID NO: 14240 - RNA, 51 nt, Artificial Sequence
  Description of Artificial Sequence: Synthetic oligonucleotide
gggaggacgaugcgggacuucuuaucuuuucuccccagacgacucgcccga

SEQ ID NO: 14241 - RNA, 51 nt, Artificial Sequence
  Description of Artificial Sequence: Synthetic oligonucleotide
gggaggacgaugcgguuuucuauuuuaacucuccccagacgacucgcccga

SEQ ID NO: 14242 - RNA, 51 nt, Artificial Sequence
  Description of Artificial Sequence: Synthetic oligonucleotide
gggaggacgaugcgguaccauuucuuucucuugugcagacgacucgcccga

SEQ ID NO: 14243 - RNA, 51 nt, Artificial Sequence
  Description of Artificial Sequence: Synthetic oligonucleotide
gggaggacgaugcgguauuuucuuuucuguguccccagacgacucgcccga

SEQ ID NO: 14244 - RNA, 51 nt, Artificial Sequence
  Description of Artificial Sequence: Synthetic oligonucleotide
gggaggacgaugcgguuuucuugcuuuuuccgcuacagacgacucgcccga

SEQ ID NO: 14245 - RNA, 52 nt, Artificial Sequence
  Description of Artificial Sequence: Synthetic oligonucleotide
gggaggacgaugcggguuuuuuuacuuauguugccgcagacgacucgcccga

SEQ ID NO: 14246 - RNA, 51 nt, Artificial Sequence
  Description of Artificial Sequence: Synthetic oligonucleotide
gggaggacgaugcgguucuuguauuaauuuuuccgcagacgacucgcccga

SEQ ID NO: 14247 - RNA, 50 nt, Artificial Sequence
  Description of Artificial Sequence: Synthetic oligonucleotide
gggaggacgaugcggucuuuucauguuuauuccccagacgacucgcccga

SEQ ID NO: 14248 - RNA, 51 nt, Artificial Sequence
  Description of Artificial Sequence: Synthetic oligonucleotide
gggaggacgaugcggcauuccuuuauuucuucgcccagacgacucgcccga

SEQ ID NO: 14249 - RNA, 53 nt, Artificial Sequence
  Description of Artificial Sequence: Synthetic oligonucleotide
gggaggacgaugcggcauucuucuguuuuuccuucgccagacgacucgcccga

SEQ ID NO: 14250 - RNA, 51 nt, Artificial Sequence
  Description of Artificial Sequence: Synthetic oligonucleotide
gggaggacgaugcggcgaauggaggaggaggaugccagacgacucgcccga

SEQ ID NO: 14251 - RNA, 51 nt, Artificial Sequence
  Description of Artificial Sequence: Synthetic oligonucleotide
gggaggacgaugcggauuuucauaucuuuucccgccagacgacucgcccga

SEQ ID NO: 14252 - RNA, 51 nt, Artificial Sequence
  Description of Artificial Sequence: Synthetic oligonucleotide
gggaggacgaugcgguuuuuguuuuguuuuugcugcagacgacucgcccga

SEQ ID NO: 14253 - RNA, 51 nt, Artificial Sequence
  Description of Artificial Sequence: Synthetic oligonucleotide
gggaggacgaugcggcuuuucuuucauuuucccggcagacgacucgcccga

SEQ ID NO: 14254 - RNA, 51 nt, Artificial Sequence
  Description of Artificial Sequence: Synthetic oligonucleotide
gggaggacgaugcgguuugcuauucauuuuucccccagacgacucgcccga

SEQ ID NO: 14255 - RNA, 51 nt, Artificial Sequence
  Description of Artificial Sequence: Synthetic oligonucleotide
gggaggacgaugcgguuugggaguaggguguucggcagacgacucgcccga

SEQ ID NO: 14256 - RNA, 51 nt, Artificial Sequence
  Description of Artificial Sequence: Synthetic oligonucleotide
gggaggacgaugcggguugguguaggggggguccgcagacgacucgcccga

SEQ ID NO: 14257 - RNA, 51 nt, Artificial Sequence
  Description of Artificial Sequence: Synthetic oligonucleotide
gggaggacgaugcgguacuuuuucuuccuuuuccacagacgacucgcccga

SEQ ID NO: 14258 - RNA, 51 nt, Artificial Sequence
  Description of Artificial Sequence: Synthetic oligonucleotide
gggaggacgaugcgguucguuuauuaauuucuccgcagacgacucgcccga

SEQ ID NO: 14259 - RNA, 51 nt, Artificial Sequence
  Description of Artificial Sequence: Synthetic oligonucleotide
gggaggacgaugcggcuuuuaaacuccuuuucccgcagacgacucgcccga

SEQ ID NO: 14260 - RNA, 51 nt, Artificial Sequence
  Description of Artificial Sequence: Synthetic oligonucleotide
gggaggacgaugcgguuuuuuagauaguuuuugugcagacgacucgcccga

SEQ ID NO: 14261 - RNA, 51 nt, Artificial Sequence
  Description of Artificial Sequence: Synthetic oligonucleotide
gggaggacgaugcgguuuccacuacauuauuuccgcagacgacucgcccga

SEQ ID NO: 14262 - RNA, 51 nt, Artificial Sequence
  Description of Artificial Sequence: Synthetic oligonucleotide
gggaggacgaugcggcuuuucucaugccuuauccgcagacgacucgcccga

SEQ ID NO: 14263 - RNA, 52 nt, Artificial Sequence
  Description of Artificial Sequence: Synthetic oligonucleotide
gggaggacgaugcgguuugcucucuauuuuuuuccgcagacgacucgcccga

SEQ ID NO: 14264 - RNA, 51 nt, Artificial Sequence
  Description of Artificial Sequence: Synthetic oligonucleotide
gggaggacgaugcggucucugucauucuauuuccgcagacgacucgcccga

SEQ ID NO: 14265 - RNA, 51 nt, Artificial Sequence
  Description of Artificial Sequence: Synthetic oligonucleotide
gggaggacgaugcggauucuacuauuacuccaccgcagacgacucgcccga

SEQ ID NO: 14266 - RNA, 51 nt, Artificial Sequence
  Description of Artificial Sequence: Synthetic oligonucleotide
gggaggacgaugcgguuucauauuucucuccucugcagacgacucgcccga

SEQ ID NO: 14267 - RNA, 51 nt, Artificial Sequence
  Description of Artificial Sequence: Synthetic oligonucleotide
gggaggacgaugcggcacucacuuuuuuucuucgccagacgacucgcccga

SEQ ID NO: 14268 - RNA, 51 nt, Artificial Sequence
  Description of Artificial Sequence: Synthetic oligonucleotide
gggaggacgaugcgggccucuccuuuuucuucccgcagacgacucgcccga

SEQ ID NO: 14269 - RNA, 52 nt, Artificial Sequence
  Description of Artificial Sequence: Synthetic oligonucleotide
gggaggacgaugcgguuuacauuuucucaccugccccagacgacucgcccga

SEQ ID NO: 14270 - RNA, 50 nt, Artificial Sequence
  Description of Artificial Sequence: Synthetic oligonucleotide
gggaggacgaugcggcuuucuuuguuuccuuccgcagacgacucgcccga

SEQ ID NO: 14271 - RNA, 51 nt, Artificial Sequence
  Description of Artificial Sequence: Synthetic oligonucleotide
gggaggacgaugcggauuuuuugccguguucuccgcagacgacucgcccga

SEQ ID NO: 14272 - RNA, 52 nt, Artificial Sequence
  Description of Artificial Sequence: Synthetic oligonucleotide
gggaggacgaugcggauuuuucucuuuuuucugccgcagacgacucgcccga

SEQ ID NO: 14273 - RNA, 51 nt, Artificial Sequence
  Description of Artificial Sequence: Synthetic oligonucleotide
gggaggacgaugcgguuuucucuuuuccuuuuccgcagacgacucgcccga

SEQ ID NO: 14274 - RNA, 53 nt, Artificial Sequence
  Description of Artificial Sequence: Synthetic oligonucleotide
gggaggacgaugcgguuucuuuuuuugucuugcuccgcagacgacucgcccga

SEQ ID NO: 14275 - RNA, 51 nt, Artificial Sequence
  Description of Artificial Sequence: Synthetic oligonucleotide
gggaggacgaugcgguuucuuuugcuuuuucuccgcagacgacucgcccga

SEQ ID NO: 14276 - RNA, 50 nt, Artificial Sequence
  Description of Artificial Sequence: Synthetic oligonucleotide
gggaggacgaugcgguuuuuugucuuuugcuccgcagacgacucgcccga

SEQ ID NO: 14277 - RNA, 52 nt, Artificial Sequence
  Description of Artificial Sequence: Synthetic oligonucleotide
gggaggacgaugcgguuuauuuuucucguuguugugcagacgacucgcccga

SEQ ID NO: 14278 - RNA, 51 nt, Artificial Sequence
  Description of Artificial Sequence: Synthetic oligonucleotide
gggaggacgaugcgguucacuuucuuuucucuccgcagacgacucgcccga

SEQ ID NO: 14279 - RNA, 50 nt, Artificial Sequence
  Description of Artificial Sequence: Synthetic oligonucleotide
gggaggacgaugcggucuuuucauguuucuuccgcagacgacucgcccga

SEQ ID NO: 14280 - RNA, 51 nt, Artificial Sequence
  Description of Artificial Sequence: Synthetic oligonucleotide
gggaggacgaugcgguuaucuaacucuuuuccccgcagacgacucgcccga

SEQ ID NO: 14281 - RNA, 51 nt, Artificial Sequence
  Description of Artificial Sequence: Synthetic oligonucleotide
gggaggacgaugcgguuguuacugauuuuauuccgcagacgacucgcccga

SEQ ID NO: 14282 - RNA, 50 nt, Artificial Sequence
  Description of Artificial Sequence: Synthetic oligonucleotide
gggaggacgaugcgguuuucacuuuuucuuugcccagacgacucgcccga

SEQ ID NO: 14283 - RNA, 51 nt, Artificial Sequence
  Description of Artificial Sequence: Synthetic oligonucleotide
gggaggacgaugcgguucauuuguauuuuaucccccagacgacucgcccga

SEQ ID NO: 14284 - RNA, 51 nt, Artificial Sequence
  Description of Artificial Sequence: Synthetic oligonucleotide
gggaggacgaugcggcaccauuuuguuuuucuccgcagacgacucgcccga

SEQ ID NO: 14285 - RNA, 51 nt, Artificial Sequence
  Description of Artificial Sequence: Synthetic oligonucleotide
gggaggacgaugcgguuccuucauuauucuugccgcagacgacucgcccga

SEQ ID NO: 14286 - RNA, 51 nt, Artificial Sequence
  Description of Artificial Sequence: Synthetic oligonucleotide
gggaggacgaugcgguucuauauuuuauucuucugcagacgacucgcccga

SEQ ID NO: 14287 - RNA, 51 nt, Artificial Sequence
  Description of Artificial Sequence: Synthetic oligonucleotide
gggaggacgaugcgguuucauacuuguuuucugcccagacgacucgcccga

SEQ ID NO: 14288 - RNA, 51 nt, Artificial Sequence
  Description of Artificial Sequence: Synthetic oligonucleotide
gggaggacgaugcgguuuguucuucucuuuuuccgcagacgacucgcccga

SEQ ID NO: 14289 - RNA, 51 nt, Artificial Sequence
  Description of Artificial Sequence: Synthetic oligonucleotide
gggaggacgaugcggucucaucuuuuuuuuuuccgcagacgacucgcccga

SEQ ID NO: 14290 - RNA, 51 nt, Artificial Sequence
  Description of Artificial Sequence: Synthetic oligonucleotide
gggaggacgaugcggcccuuuauuugcuuauuccgcagacgacucgcccga

SEQ ID NO: 14291 - RNA, 51 nt, Artificial Sequence
  Description of Artificial Sequence: Synthetic oligonucleotide
gggaggacgaugcggcucucuuuuuauucuuuccgcagacgacucgcccga

SEQ ID NO: 14292 - RNA, 51 nt, Artificial Sequence
  Description of Artificial Sequence: Synthetic oligonucleotide
gggaggacgaugcggacuuuuacuuuauccugcugcagacgacucgcccga

SEQ ID NO: 14293 - RNA, 51 nt, Artificial Sequence
  Description of Artificial Sequence: Synthetic oligonucleotide
gggaggacgaugcgguuugggaguaggguguuucgcagacgacucgcccga

SEQ ID NO: 14294 - RNA, 52 nt, Artificial Sequence
  Description of Artificial Sequence: Synthetic oligonucleotide
gggaggacgaugcgguuuuccauuuuuuucacuccgcagacgacucgcccga

SEQ ID NO: 14295 - RNA, 51 nt, Artificial Sequence
  Description of Artificial Sequence: Synthetic oligonucleotide
gggaggacgaugcggggugaagggugauggguccgcagacgacucgcccga

SEQ ID NO: 14296 - RNA, 51 nt, Artificial Sequence
  Description of Artificial Sequence: Synthetic oligonucleotide
gggaggacgaugcgguuuguuuuucccuuuuuccgcagacgacucgcccga

SEQ ID NO: 14297 - RNA, 51 nt, Artificial Sequence
  Description of Artificial Sequence: Synthetic oligonucleotide
gggaggacgaugcggcuuauggaguagggaggcgccagacgacucgcccga

SEQ ID NO: 14298 - RNA, 52 nt, Artificial Sequence
  Description of Artificial Sequence: Synthetic oligonucleotide
gggaggacgaugcggccaucucuuuuuuuuccuccgcagacgacucgcccga

SEQ ID NO: 14299 - RNA, 52 nt, Artificial Sequence
  Description of Artificial Sequence: Synthetic oligonucleotide
gggaggacgaugcgguuuguuuuuugugcuuuuccccagacgacucgcccga

SEQ ID NO: 14300 - RNA, 51 nt, Artificial Sequence
  Description of Artificial Sequence: Synthetic oligonucleotide
gggaggacgaugcggcuuuuuuagaucuuuuuccgcagacgacucgcccga

SEQ ID NO: 14301 - RNA, 51 nt, Artificial Sequence
  Description of Artificial Sequence: Synthetic oligonucleotide
gggaggacgaugcggcaacuuuucuuuuuauuccccagacgacucgcccga

SEQ ID NO: 14302 - RNA, 51 nt, Artificial Sequence
  Description of Artificial Sequence: Synthetic oligonucleotide
gggaggacgaugcggcuuuuucuuuucccuuuccgcagacgacucgcccga

SEQ ID NO: 14303 - RNA, 50 nt, Artificial Sequence
  Description of Artificial Sequence: Synthetic oligonucleotide
gggaggacgaugcgguuuucuaucuuuuuguccgcagacgacucgcccga

SEQ ID NO: 14304 - RNA, 52 nt, Artificial Sequence
  Description of Artificial Sequence: Synthetic oligonucleotide
gggaggacgaugcggcuuuucucuucuugucuaccgcagacgacucgcccga

SEQ ID NO: 14305 - RNA, 51 nt, Artificial Sequence
  Description of Artificial Sequence: Synthetic oligonucleotide
gggaggacgaugcgguuugaagugugauguguccgcagacgacucgcccga

SEQ ID NO: 14306 - RNA, 51 nt, Artificial Sequence
  Description of Artificial Sequence: Synthetic oligonucleotide
gggaggacgaugcggucuuuuuauuugccuuuccgcagacgacucgcccga

SEQ ID NO: 14307 - RNA, 51 nt, Artificial Sequence
  Description of Artificial Sequence: Synthetic oligonucleotide
gggaggacgaugcggccuuuuaacauguuuuuccgcagacgacucgcccga

SEQ ID NO: 14308 - RNA, 52 nt, Artificial Sequence
  Description of Artificial Sequence: Synthetic oligonucleotide
gggaggacgaugcgguuucauuuuucucuacuuccgcagacgacucgcccga

SEQ ID NO: 14309 - RNA, 51 nt, Artificial Sequence
  Description of Artificial Sequence: Synthetic oligonucleotide
gggaggacgaugcggcuuauuaucucguucuuccgcagacgacucgcccga

SEQ ID NO: 14310 - RNA, 51 nt, Artificial Sequence
  Description of Artificial Sequence: Synthetic oligonucleotide
gggaggacgaugcggcuuucacuuuuuuucuuccgcagacgacucgcccga

SEQ ID NO: 14311 - RNA, 53 nt, Artificial Sequence
  Description of Artificial Sequence: Synthetic oligonucleotide
gggaggacgaugcggaauuauuuguuuuuugugaccgcagacgacucgcccga

SEQ ID NO: 14312 - RNA, 51 nt, Artificial Sequence
  Description of Artificial Sequence: Synthetic oligonucleotide
gggaggacgaugcggaaccauaauguguggugccccagacgacucgcccga

SEQ ID NO: 14313 - RNA, 51 nt, Artificial Sequence
  Description of Artificial Sequence: Synthetic oligonucleotide
gggaggacgaugcggugugggaguaggguguuccgcagacgacucgcccga

SEQ ID NO: 14314 - RNA, 51 nt, Artificial Sequence
  Description of Artificial Sequence: Synthetic oligonucleotide
gggaggacgaugcggcguuuccucuguuucguccccagacgacucgcccga

SEQ ID NO: 14315 - RNA, 49 nt, Artificial Sequence
  Description of Artificial Sequence: Synthetic oligonucleotide
gggaggacgaugcgguuggguguaggguggugccagacgacucgcccga

SEQ ID NO: 14316 - RNA, 51 nt, Artificial Sequence
  Description of Artificial Sequence: Synthetic oligonucleotide
gggaggacgaugcggugacucgucuguuccguccccagacgacucgcccga

SEQ ID NO: 14317 - RNA, 50 nt, Artificial Sequence
  Description of Artificial Sequence: Synthetic oligonucleotide
gggaggacgaugcgguugguguagggggguuccgcagacgacucgcccga

SEQ ID NO: 14318 - RNA, 51 nt, Artificial Sequence
  Description of Artificial Sequence: Synthetic oligonucleotide
gggaggacgaugcgguccugucuucugcucguccccagacgacucgcccga

SEQ ID NO: 14319 - RNA, 51 nt, Artificial Sequence
  Description of Artificial Sequence: Synthetic oligonucleotide
gggaggacgaugcgggcccuucguucuacccuccccagacgacucgcccga

SEQ ID NO: 14320 - RNA, 51 nt, Artificial Sequence
  Description of Artificial Sequence: Synthetic oligonucleotide
gggaggacgaugcgguuugaaaggugauggguccccagacgacucgcccga

SEQ ID NO: 14321 - RNA, 51 nt, Artificial Sequence
  Description of Artificial Sequence: Synthetic oligonucleotide
gggaggacgaugcgguuugaagggcuauugguccgcagacgacucgcccga

SEQ ID NO: 14322 - RNA, 51 nt, Artificial Sequence
  Description of Artificial Sequence: Synthetic oligonucleotide
gggaggacgaugcgguuugggguuuucgcgugccccagacgacucgcccga

SEQ ID NO: 14323 - RNA, 51 nt, Artificial Sequence
  Description of Artificial Sequence: Synthetic oligonucleotide
gggaggacgaugcgguuuacucuuuucuuugcccccagacgacucgcccga

SEQ ID NO: 14324 - RNA, 51 nt, Artificial Sequence
  Description of Artificial Sequence: Synthetic oligonucleotide
gggaggacgaugcgguuucuucaccacuuuccccgcagacgacucgcccga

SEQ ID NO: 14325 - RNA, 51 nt, Artificial Sequence
  Description of Artificial Sequence: Synthetic oligonucleotide
gggaggacgaugcgguauuccucaucuuuucgccgcagacgacucgcccga

SEQ ID NO: 14326 - RNA, 51 nt, Artificial Sequence
  Description of Artificial Sequence: Synthetic oligonucleotide
gggaggacgaugcggcgauuccucuaguucguccccagacgacucgcccga

SEQ ID NO: 14327 - RNA, 51 nt, Artificial Sequence
  Description of Artificial Sequence: Synthetic oligonucleotide
gggaggacgaugcggcuuuucuuaauuucgcuccgcagacgacucgcccga

SEQ ID NO: 14328 - RNA, 52 nt, Artificial Sequence
  Description of Artificial Sequence: Synthetic oligonucleotide
gggaggacgaugcggguccugacgucuguucguccccagacgacucgcccga

SEQ ID NO: 14329 - RNA, 51 nt, Artificial Sequence
  Description of Artificial Sequence: Synthetic oligonucleotide
gggaggacgaugcgguauucucacacuuuuugccccagacgacucgcccga

SEQ ID NO: 14330 - RNA, 51 nt, Artificial Sequence
  Description of Artificial Sequence: Synthetic oligonucleotide
gggaggacgaugcgguccuuucguucuccccuccccagacgacucgcccga

SEQ ID NO: 14331 - RNA, 50 nt, Artificial Sequence
  Description of Artificial Sequence: Synthetic oligonucleotide
gggaggacgaugcgguuauuuuccuuuucugccgcagacgacucgcccga

SEQ ID NO: 14332 - RNA, 51 nt, Artificial Sequence
  Description of Artificial Sequence: Synthetic oligonucleotide
gggaggacgaugcggucacaauuucuuuacguccccagacgacucgcccga

SEQ ID NO: 14333 - RNA, 51 nt, Artificial Sequence
  Description of Artificial Sequence: Synthetic oligonucleotide
gggaggacgaugcgguccuuucguucugcccuucccagacgacucgcccga

SEQ ID NO: 14334 - RNA, 51 nt, Artificial Sequence
  Description of Artificial Sequence: Synthetic oligonucleotide
gggaggacgaugcgggucacuuuuaauucccuccgcagacgacucgcccga

SEQ ID NO: 14335 - RNA, 50 nt, Artificial Sequence
  Description of Artificial Sequence: Synthetic oligonucleotide
gggaggacgaugcgguuuauuucucguuguugugcagacgacucgcccga

SEQ ID NO: 14336 - RNA, 51 nt, Artificial Sequence
  Description of Artificial Sequence: Synthetic oligonucleotide
gggaggacgaugcggaguuuuugccuuguuguccgcagacgacucgcccga

SEQ ID NO: 14337 - RNA, 51 nt, Artificial Sequence
  Description of Artificial Sequence: Synthetic oligonucleotide
gggaggacgaugcggguuuuccacuuuuuuauccccagacgacucgcccga

SEQ ID NO: 14338 - RNA, 51 nt, Artificial Sequence
  Description of Artificial Sequence: Synthetic oligonucleotide
gggaggacgaugcggucaucacuuuucuucugccgcagacgacucgcccga

SEQ ID NO: 14339 - RNA, 52 nt, Artificial Sequence
  Description of Artificial Sequence: Synthetic oligonucleotide
gggaggacgaugcggguuuugucuuuuuuccuuccgcagacgacucgcccga

SEQ ID NO: 14340 - RNA, 51 nt, Artificial Sequence
  Description of Artificial Sequence: Synthetic oligonucleotide
gggaggacgaugcggucacauuuauuuuucugcugcagacgacucgcccga

SEQ ID NO: 14341 - RNA, 51 nt, Artificial Sequence
  Description of Artificial Sequence: Synthetic oligonucleotide
gggaggacgaugcgguuugggaggagggggguccgcagacgacucgcccga

SEQ ID NO: 14342 - RNA, 51 nt, Artificial Sequence
  Description of Artificial Sequence: Synthetic oligonucleotide
gggaggacgaugcgguuccuuauuuuuucccuccgcagacgacucgcccga

SEQ ID NO: 14343 - RNA, 49 nt, Artificial Sequence
  Description of Artificial Sequence: Synthetic oligonucleotide
gggaggacgaugcggcuuuucuucgcuuuaccgcagacgacucgcccga

SEQ ID NO: 14344 - RNA, 51 nt, Artificial Sequence
  Description of Artificial Sequence: Synthetic oligonucleotide
gggaggacgaugcggccuuuuaccacuuuccuccgcagacgacucgcccga

SEQ ID NO: 14345 - RNA, 51 nt, Artificial Sequence
  Description of Artificial Sequence: Synthetic oligonucleotide
gggaggacgaugcgguuucuaauuuuugucgugugcagacgacucgcccga

SEQ ID NO: 14346 - RNA, 49 nt, Artificial Sequence
  Description of Artificial Sequence: Synthetic oligonucleotide
gggaggacgaugcggccuuucguucucccuccccagacgacucgcccga

SEQ ID NO: 14347 - RNA, 51 nt, Artificial Sequence
  Description of Artificial Sequence: Synthetic oligonucleotide
gggaggacgaugcgguccuuucguucggcccuccccagacgacucgcccga

SEQ ID NO: 14348 - RNA, 50 nt, Artificial Sequence
  Description of Artificial Sequence: Synthetic oligonucleotide
gggaggacgaugcggccuuucguucugcucuccccagacgacucgcccga

SEQ ID NO: 14349 - RNA, 51 nt, Artificial Sequence
  Description of Artificial Sequence: Synthetic oligonucleotide
gggaggacgaugcgguuucucuuuuccucuuuccgcagacgacucgcccga

SEQ ID NO: 14350 - RNA, 51 nt, Artificial Sequence
  Description of Artificial Sequence: Synthetic oligonucleotide
gggaggacgaugcgguuucuuacuaguuuucugcccagacgacucgcccga

SEQ ID NO: 14351 - RNA, 51 nt, Artificial Sequence
  Description of Artificial Sequence: Synthetic oligonucleotide
gggaggacgaugcggucuuucugucuuuugcuccgcagacgacucgcccga

SEQ ID NO: 14352 - RNA, 53 nt, Artificial Sequence
  Description of Artificial Sequence: Synthetic oligonucleotide
gggaggacgaugcggaauuauuguuuuuuugugaccgcagacgacucgcccga

SEQ ID NO: 14353 - RNA, 51 nt, Artificial Sequence
  Description of Artificial Sequence: Synthetic oligonucleotide
gggaggacgaugcggaucuuuuccuucuucugccgcagacgacucgcccga

SEQ ID NO: 14354 - RNA, 51 nt, Artificial Sequence
  Description of Artificial Sequence: Synthetic oligonucleotide
gggaggacgaugcgguuugggaguaggguauuccgcagacgacucgcccga

SEQ ID NO: 14355 - RNA, 51 nt, Artificial Sequence
  Description of Artificial Sequence: Synthetic oligonucleotide
gggaggacgaugcgguccugucgucuguucguaaccagacgacucgcccga

SEQ ID NO: 14356 - RNA, 51 nt, Artificial Sequence
  Description of Artificial Sequence: Synthetic oligonucleotide
gggaggacgaugcgguacuuuccuuguuuucuccgcagacgacucgcccga

SEQ ID NO: 14357 - RNA, 52 nt, Artificial Sequence
  Description of Artificial Sequence: Synthetic oligonucleotide
gggaggacgaugcgguuugaaggggugauggguccucagacgacucgcccga

SEQ ID NO: 14358 - RNA, 51 nt, Artificial Sequence
  Description of Artificial Sequence: Synthetic oligonucleotide
gggaggacgaugcggauuuggaggaggagguuccccagacgacucgcccga

SEQ ID NO: 14359 - RNA, 53 nt, Artificial Sequence
  Description of Artificial Sequence: Synthetic oligonucleotide
gggaggacgaugcggacucuguuuuuuuucccuuccgcagacgacucgcccga

SEQ ID NO: 14360 - RNA, 51 nt, Artificial Sequence
  Description of Artificial Sequence: Synthetic oligonucleotide
gggaggacgaugcggacuuuuucauucucucugcccagacgacucgcccga

SEQ ID NO: 14361 - RNA, 51 nt, Artificial Sequence
  Description of Artificial Sequence: Synthetic oligonucleotide
gggaggacgaugcggccuuucaugcauuuucuccgcagacgacucgcccga

SEQ ID NO: 14362 - RNA, 52 nt, Artificial Sequence
  Description of Artificial Sequence: Synthetic oligonucleotide
gggaggacgaugcggacauuucguuuuuucucgccgcagacgacucgcccga

SEQ ID NO: 14363 - RNA, 51 nt, Artificial Sequence
  Description of Artificial Sequence: Synthetic oligonucleotide
gggaggacgaugcgguuuuauuugccccuuuuccccagacgacucgcccga

SEQ ID NO: 14364 - RNA, 51 nt, Artificial Sequence
  Description of Artificial Sequence: Synthetic oligonucleotide
gggaggacgaugcggacuuuugaucuuuuacaccgcagacgacucgcccga

SEQ ID NO: 14365 - RNA, 51 nt, Artificial Sequence
  Description of Artificial Sequence: Synthetic oligonucleotide
gggaggacgaugcggaucuuuuucuuuuuccaccacagacgacucgcccga

SEQ ID NO: 14366 - RNA, 51 nt, Artificial Sequence
  Description of Artificial Sequence: Synthetic oligonucleotide
gggaggacgaugcggauuucucuuauuuccuccgccagacgacucgcccga

SEQ ID NO: 14367 - RNA, 51 nt, Artificial Sequence
  Description of Artificial Sequence: Synthetic oligonucleotide
gggaggacgaugcggauuuccuuuuaccuucaccgcagacgacucgcccga

SEQ ID NO: 14368 - RNA, 51 nt, Artificial Sequence
  Description of Artificial Sequence: Synthetic oligonucleotide
gggaggacgaugcgguuucaccucuuuuucugccgcagacgacucgcccga

SEQ ID NO: 14369 - RNA, 52 nt, Artificial Sequence
  Description of Artificial Sequence: Synthetic oligonucleotide
gggaggacgaugcgguuacucauuuuauuuucuccgcagacgacucgcccga

SEQ ID NO: 14370 - RNA, 51 nt, Artificial Sequence
  Description of Artificial Sequence: Synthetic oligonucleotide
gggaggacgaugcggacguuuacauucuuucaccgcagacgacucgcccga

SEQ ID NO: 14371 - RNA, 51 nt, Artificial Sequence
  Description of Artificial Sequence: Synthetic oligonucleotide
gggaggacgaugcgggccuuucguucuuuucuccccagacgacucgcccga

SEQ ID NO: 14372 - RNA, 51 nt, Artificial Sequence
  Description of Artificial Sequence: Synthetic oligonucleotide
gggaggacgaugcggcauucuuuguuguuucucgccagacgacucgcccga

SEQ ID NO: 14373 - RNA, 50 nt, Artificial Sequence
  Description of Artificial Sequence: Synthetic oligonucleotide
gggaggacgaugcgguuuuauguugauuugugugcagacgacucgcccga

SEQ ID NO: 14374 - RNA, 51 nt, Artificial Sequence
  Description of Artificial Sequence: Synthetic oligonucleotide
gggaggacgaugcgguuuuaugggugauggguccgcagacgacucgcccga

SEQ ID NO: 14375 - RNA, 51 nt, Artificial Sequence
  Description of Artificial Sequence: Synthetic oligonucleotide
gggaggacgaugcggucuucuuguuacucguuccgcagacgacucgcccga

SEQ ID NO: 14376 - RNA, 51 nt, Artificial Sequence
  Description of Artificial Sequence: Synthetic oligonucleotide
gggaggacgaugcgggccuuucguucuaccuuccccagacgacucgcccga

SEQ ID NO: 14377 - RNA, 51 nt, Artificial Sequence
  Description of Artificial Sequence: Synthetic oligonucleotide
gggaggacgaugcgguauuuaccuuucuuuccccgcagacgacucgcccga

SEQ ID NO: 14378 - RNA, 51 nt, Artificial Sequence
  Description of Artificial Sequence: Synthetic oligonucleotide
gggaggacgaugcgguuacuuauuucuucuuugcccagacgacucgcccga

SEQ ID NO: 14379 - RNA, 53 nt, Artificial Sequence
  Description of Artificial Sequence: Synthetic oligonucleotide
gggaggacgaugcgguuuuucguguuuuuuugcaccucagacgacucgcccga

SEQ ID NO: 14380 - RNA, 51 nt, Artificial Sequence
  Description of Artificial Sequence: Synthetic oligonucleotide
gggaggacgaugcgggcugaagggugauggguccgcagacgacucgcccga

SEQ ID NO: 14381 - RNA, 50 nt, Artificial Sequence
  Description of Artificial Sequence: Synthetic oligonucleotide
gggaggacgaugcggcuuucacuuuuuuucuccgcagacgacucgcccga

SEQ ID NO: 14382 - RNA, 51 nt, Artificial Sequence
  Description of Artificial Sequence: Synthetic oligonucleotide
gggaggacgaugcggguugaugggugauggguccgcagacgacucgcccga

SEQ ID NO: 14383 - RNA, 50 nt, Artificial Sequence
  Description of Artificial Sequence: Synthetic oligonucleotide
gggaggacgaugcgguauuuucuucuuuucuccgcagacgacucgcccga

SEQ ID NO: 14384 - RNA, 51 nt, Artificial Sequence
  Description of Artificial Sequence: Synthetic oligonucleotide
gggaggacgaugcggccuuuuacuuuuucucuccgcagacgacucgcccga

SEQ ID NO: 14385 - RNA, 51 nt, Artificial Sequence
  Description of Artificial Sequence: Synthetic oligonucleotide
gggaggacgaugcggucuuguuuuuuuuuugccgccagacgacucgcccga

SEQ ID NO: 14386 - RNA, 51 nt, Artificial Sequence
  Description of Artificial Sequence: Synthetic oligonucleotide
gggaggacgaugcgggccguucggucugcccuccccagacgacucgcccga

SEQ ID NO: 14387 - RNA, 51 nt, Artificial Sequence
  Description of Artificial Sequence: Synthetic oligonucleotide
gggaggacgaugcggaucacucuuucucuuuugcccagacgacucgcccga

SEQ ID NO: 14388 - RNA, 50 nt, Artificial Sequence
  Description of Artificial Sequence: Synthetic oligonucleotide
gggaggacgaugcgguuggguguagggugguagccagacgacucgcccga

SEQ ID NO: 14389 - RNA, 50 nt, Artificial Sequence
  Description of Artificial Sequence: Synthetic oligonucleotide
gggaggacgaugcgguuuuuguuuuguuuuggugcagacgacucgcccga

SEQ ID NO: 14390 - RNA, 51 nt, Artificial Sequence
  Description of Artificial Sequence: Synthetic oligonucleotide
gggaggacgaugcgggcuacuuuuuacucuuuccgcagacgacucgcccga

SEQ ID NO: 14391 - RNA, 53 nt, Artificial Sequence
  Description of Artificial Sequence: Synthetic oligonucleotide
gggaggacgaugcggacauucucuuuuuuuuucaccgcagacgacucgcccga

SEQ ID NO: 14392 - RNA, 51 nt, Artificial Sequence
  Description of Artificial Sequence: Synthetic oligonucleotide
gggaggacgaugcggccuuuucugucuucuacccgcagacgacucgcccga

SEQ ID NO: 14393 - RNA, 51 nt, Artificial Sequence
  Description of Artificial Sequence: Synthetic oligonucleotide
gggaggacgaugcggacuuuaacauucuucuuccgcagacgacucgcccga

SEQ ID NO: 14394 - RNA, 52 nt, Artificial Sequence
  Description of Artificial Sequence: Synthetic oligonucleotide
gggaggacgaugcggucguugucuuuuuuuuugccccagacgacucgcccga

SEQ ID NO: 14395 - RNA, 51 nt, Artificial Sequence
  Description of Artificial Sequence: Synthetic oligonucleotide
gggaggacgaugcggauuuccuaaugcuucuaccgcagacgacucgcccga

SEQ ID NO: 14396 - RNA, 53 nt, Artificial Sequence
  Description of Artificial Sequence: Synthetic oligonucleotide
gggaggacgaugcggguuccauuuuuuuuuuccaccgcagacgacucgcccga

SEQ ID NO: 14397 - RNA, 53 nt, Artificial Sequence
  Description of Artificial Sequence: Synthetic oligonucleotide
gggaggacgaugcgguuuuucucacaauucucauccucagacgacucgcccga

SEQ ID NO: 14398 - RNA, 51 nt, Artificial Sequence
  Description of Artificial Sequence: Synthetic oligonucleotide
gggaggacgaugcgguuuuuauuuuccugguuccgcagacgacucgcccga

SEQ ID NO: 14399 - RNA, 51 nt, Artificial Sequence
  Description of Artificial Sequence: Synthetic oligonucleotide
gggaggacgaugcggguuuacuuuuucuccauucccagacgacucgcccga

SEQ ID NO: 14400 - RNA, 51 nt, Artificial Sequence
  Description of Artificial Sequence: Synthetic oligonucleotide
gggaggacgaugcgguguuuucucuuuguuuacugcagacgacucgcccga

SEQ ID NO: 14401 - RNA, 51 nt, Artificial Sequence
  Description of Artificial Sequence: Synthetic oligonucleotide
gggaggacgaugcgguuucuuuauauuuaugcccccagacgacucgcccga

SEQ ID NO: 14402 - RNA, 51 nt, Artificial Sequence
  Description of Artificial Sequence: Synthetic oligonucleotide
gggaggacgaugcggucuuuuacaaacacucuccgcagacgacucgcccga

SEQ ID NO: 14403 - RNA, 51 nt, Artificial Sequence
  Description of Artificial Sequence: Synthetic oligonucleotide
gggaggacgaugcggccuuaauuuucacuuucccgcagacgacucgcccga

SEQ ID NO: 14404 - RNA, 51 nt, Artificial Sequence
  Description of Artificial Sequence: Synthetic oligonucleotide
gggaggacgaugcgguuuucuguuuuguucauccgcagacgacucgcccga

SEQ ID NO: 14405 - RNA, 52 nt, Artificial Sequence
  Description of Artificial Sequence: Synthetic oligonucleotide
gggaggacgaugcggaguuuuuauuucuauuuugcccagacgacucgcccga

SEQ ID NO: 14406 - RNA, 52 nt, Artificial Sequence
  Description of Artificial Sequence: Synthetic oligonucleotide
gggaggacgaugcgguguuuuaguucuuuuucucgccagacgacucgcccga

SEQ ID NO: 14407 - RNA, 51 nt, Artificial Sequence
  Description of Artificial Sequence: Synthetic oligonucleotide
gggaggacgaugcggccacuuaaauuuuuucuccgcagacgacucgcccga

SEQ ID NO: 14408 - RNA, 51 nt, Artificial Sequence
  Description of Artificial Sequence: Synthetic oligonucleotide
gggaggacgaugcggaucuuacuacuuuucuccgccagacgacucgcccga

SEQ ID NO: 14409 - RNA, 51 nt, Artificial Sequence
  Description of Artificial Sequence: Synthetic oligonucleotide
gggaggacgaugcggucuuucacuauuuuuauccccagacgacucgcccga

SEQ ID NO: 14410 - RNA, 51 nt, Artificial Sequence
  Description of Artificial Sequence: Synthetic oligonucleotide
gggaggacgaugcggccuuacuuacuuuacuuccgcagacgacucgcccga

SEQ ID NO: 14411 - RNA, 52 nt, Artificial Sequence
  Description of Artificial Sequence: Synthetic oligonucleotide
gggaggacgaugcggacacuuuuuuuuucacuuccccagacgacucgcccga

SEQ ID NO: 14412 - RNA, 51 nt, Artificial Sequence
  Description of Artificial Sequence: Synthetic oligonucleotide
gggaggacgaugcgguuucuucuaucuuuuucccccagacgacucgcccga

SEQ ID NO: 14413 - RNA, 51 nt, Artificial Sequence
  Description of Artificial Sequence: Synthetic oligonucleotide
gggaggacgaugcggccauuuuaauucuuuuaccgcagacgacucgcccga

SEQ ID NO: 14414 - RNA, 52 nt, Artificial Sequence
  Description of Artificial Sequence: Synthetic oligonucleotide
gggaggacgaugcggucuuuuuuuuuacuuuccccgcagacgacucgcccga

SEQ ID NO: 14415 - RNA, 52 nt, Artificial Sequence
  Description of Artificial Sequence: Synthetic oligonucleotide
gggaggacgaugcgguuauuuacuuccuuuucacaccagacgacucgcccga

SEQ ID NO: 14416 - RNA, 51 nt, Artificial Sequence
  Description of Artificial Sequence: Synthetic oligonucleotide
gggaggacgaugcggauuuugaccuuuuuuacccgcagacgacucgcccga

SEQ ID NO: 14417 - RNA, 51 nt, Artificial Sequence
  Description of Artificial Sequence: Synthetic oligonucleotide
gggaggacgaugcgguuuuuucuugacuuuaucugcagacgacucgcccga

SEQ ID NO: 14418 - RNA, 51 nt, Artificial Sequence
  Description of Artificial Sequence: Synthetic oligonucleotide
gggaggacgaugcgguuuuguucucuauuccucugcagacgacucgcccga

SEQ ID NO: 14419 - RNA, 52 nt, Artificial Sequence
  Description of Artificial Sequence: Synthetic oligonucleotide
gggaggacgaugcggcuuuuuuuucuuuuguucccgcagacgacucgcccga

SEQ ID NO: 14420 - RNA, 51 nt, Artificial Sequence
  Description of Artificial Sequence: Synthetic oligonucleotide
gggaggacgaugcggccacuuacacacuuuuuccgcagacgacucgcccga

SEQ ID NO: 14421 - RNA, 52 nt, Artificial Sequence
  Description of Artificial Sequence: Synthetic oligonucleotide
gggaggacgaugcgguuuuucuaucuuuuuuguccgcagacgacucgcccga

SEQ ID NO: 14422 - RNA, 52 nt, Artificial Sequence
  Description of Artificial Sequence: Synthetic oligonucleotide
gggaggacgaugcggaucuuuuuuucucuuaccgcccagacgacucgcccga

SEQ ID NO: 14423 - RNA, 51 nt, Artificial Sequence
  Description of Artificial Sequence: Synthetic oligonucleotide
gggaggacgaugcgggguuuuucgcuuuauuuccccagacgacucgcccga

SEQ ID NO: 14424 - RNA, 51 nt, Artificial Sequence
  Description of Artificial Sequence: Synthetic oligonucleotide
gggaggacgaugcgguaucgcuuacuuuauuuccgcagacgacucgcccga

SEQ ID NO: 14425 - RNA, 51 nt, Artificial Sequence
  Description of Artificial Sequence: Synthetic oligonucleotide
gggaggacgaugcggguuuauuuuuuuguguuccgcagacgacucgcccga

SEQ ID NO: 14426 - RNA, 51 nt, Artificial Sequence
  Description of Artificial Sequence: Synthetic oligonucleotide
gggaggacgaugcgguuauauuuccucuucuuccgcagacgacucgcccga

SEQ ID NO: 14427 - RNA, 51 nt, Artificial Sequence
  Description of Artificial Sequence: Synthetic oligonucleotide
gggaggacgaugcggucuucuacucauuuuuuccgcagacgacucgcccga

SEQ ID NO: 14428 - RNA, 51 nt, Artificial Sequence
  Description of Artificial Sequence: Synthetic oligonucleotide
gggaggacgaugcggauuuuacuucacuuugaccgcagacgacucgcccga

SEQ ID NO: 14429 - RNA, 51 nt, Artificial Sequence
  Description of Artificial Sequence: Synthetic oligonucleotide
gggaggacgaugcggauuuuacuuucuucaucccgcagacgacucgcccga

SEQ ID NO: 14430 - RNA, 51 nt, Artificial Sequence
  Description of Artificial Sequence: Synthetic oligonucleotide
gggaggacgaugcggucuaacuauucuuuccuccgcagacgacucgcccga

SEQ ID NO: 14431 - RNA, 51 nt, Artificial Sequence
  Description of Artificial Sequence: Synthetic oligonucleotide
gggaggacgaugcgggaccuuucuuguuucuaccccagacgacucgcccga

SEQ ID NO: 14432 - RNA, 51 nt, Artificial Sequence
  Description of Artificial Sequence: Synthetic oligonucleotide
gggaggacgaugcggcuuuucauuucaauucuccgcagacgacucgcccga

SEQ ID NO: 14433 - RNA, 53 nt, Artificial Sequence
  Description of Artificial Sequence: Synthetic oligonucleotide
gggaggacgaugcggcuuugucuauuuuuuuuuuccgcagacgacucgcccga

SEQ ID NO: 14434 - RNA, 51 nt, Artificial Sequence
  Description of Artificial Sequence: Synthetic oligonucleotide
gggaggacgaugcggucuuuacuauauuucacccgcagacgacucgcccga

SEQ ID NO: 14435 - RNA, 50 nt, Artificial Sequence
  Description of Artificial Sequence: Synthetic oligonucleotide
gggaggacgaugcggcuuuucuuucucuuuuccgcagacgacucgcccga

SEQ ID NO: 14436 - RNA, 51 nt, Artificial Sequence
  Description of Artificial Sequence: Synthetic oligonucleotide
gggaggacgaugcggacuuuuauccauuuaucccgcagacgacucgcccga

SEQ ID NO: 14437 - RNA, 51 nt, Artificial Sequence
  Description of Artificial Sequence: Synthetic oligonucleotide
gggaggacgaugcgggaacucuuuuuuuuucgccccagacgacucgcccga

SEQ ID NO: 14438 - RNA, 51 nt, Artificial Sequence
  Description of Artificial Sequence: Synthetic oligonucleotide
gggaggacgaugcggacuuguuccuucuuucgccgcagacgacucgcccga

SEQ ID NO: 14439 - RNA, 51 nt, Artificial Sequence
  Description of Artificial Sequence: Synthetic oligonucleotide
gggaggacgaugcggcucuuacacuucccuuaccgcagacgacucgcccga

SEQ ID NO: 14440 - RNA, 51 nt, Artificial Sequence
  Description of Artificial Sequence: Synthetic oligonucleotide
gggaggacgaugcggguuuuucguucugcccuccccagacgacucgcccga

SEQ ID NO: 14441 - RNA, 51 nt, Artificial Sequence
  Description of Artificial Sequence: Synthetic oligonucleotide
gggaggacgaugcggugccguagucuauccgcccgcagacgacucgcccga

SEQ ID NO: 14442 - RNA, 52 nt, Artificial Sequence
  Description of Artificial Sequence: Synthetic oligonucleotide
gggaggacgaugcgguuuuauuucuuuuuuuccccccagacgacucgcccga

SEQ ID NO: 14443 - RNA, 51 nt, Artificial Sequence
  Description of Artificial Sequence: Synthetic oligonucleotide
gggaggacgaugcggccauuuuguuuuuguuuccgcagacgacucgcccga

SEQ ID NO: 14444 - RNA, 51 nt, Artificial Sequence
  Description of Artificial Sequence: Synthetic oligonucleotide
gggaggacgaugcgguuucucuuucuuuucucccccagacgacucgcccga

SEQ ID NO: 14445 - RNA, 51 nt, Artificial Sequence
  Description of Artificial Sequence: Synthetic oligonucleotide
gggaggacgaugcggaccuuauuuuuuguuugccgcagacgacucgcccga

SEQ ID NO: 14446 - RNA, 52 nt, Artificial Sequence
  Description of Artificial Sequence: Synthetic oligonucleotide
gggaggacgaugcggauuuuuacuguucucuuuccccagacgacucgcccga

SEQ ID NO: 14447 - RNA, 51 nt, Artificial Sequence
  Description of Artificial Sequence: Synthetic oligonucleotide
gggaggacgaugcggcuuuuauuaucucuuuccgccagacgacucgcccga

SEQ ID NO: 14448 - RNA, 51 nt, Artificial Sequence
  Description of Artificial Sequence: Synthetic oligonucleotide
gggaggacgaugcgguucucuucuuucuuuccccgcagacgacucgcccga

SEQ ID NO: 14449 - RNA, 51 nt, Artificial Sequence
  Description of Artificial Sequence: Synthetic oligonucleotide
gggaggacgaugcggauuucaaucuuuuccuaccgcagacgacucgcccga

SEQ ID NO: 14450 - RNA, 51 nt, Artificial Sequence
  Description of Artificial Sequence: Synthetic oligonucleotide
gggaggacgaugcgguuuucuauuucucuucuguacagacgacucgcccga

SEQ ID NO: 14451 - RNA, 51 nt, Artificial Sequence
  Description of Artificial Sequence: Synthetic oligonucleotide
gggaggacgaugcggcauuucuauuauucccucgccagacgacucgcccga

SEQ ID NO: 14452 - RNA, 51 nt, Artificial Sequence
  Description of Artificial Sequence: Synthetic oligonucleotide
gggaggacgaugcgguuauuauucuuuucuucgcccagacgacucgcccga

SEQ ID NO: 14453 - RNA, 52 nt, Artificial Sequence
  Description of Artificial Sequence: Synthetic oligonucleotide
gggaggacgaugcgguuucucuuuuuucucuuuccgcagacgacucgcccga

SEQ ID NO: 14454 - RNA, 51 nt, Artificial Sequence
  Description of Artificial Sequence: Synthetic oligonucleotide
gggaggacgaugcggcuuuuucacguuuuuuccugcagacgacucgcccga

SEQ ID NO: 14455 - RNA, 50 nt, Artificial Sequence
  Description of Artificial Sequence: Synthetic oligonucleotide
gggaggacgaugcgguuuuuguuuguuuuuggugcagacgacucgcccga

SEQ ID NO: 14456 - RNA, 51 nt, Artificial Sequence
  Description of Artificial Sequence: Synthetic oligonucleotide
gggaggacgaugcggaauuauccuuuuucaccccgcagacgacucgcccga

SEQ ID NO: 14457 - RNA, 50 nt, Artificial Sequence
  Description of Artificial Sequence: Synthetic oligonucleotide
gggaggacgaugcgguuucuuuuuauuuccccugcagacgacucgcccga

SEQ ID NO: 14458 - RNA, 51 nt, Artificial Sequence
  Description of Artificial Sequence: Synthetic oligonucleotide
gggaggacgaugcggccuauaccuguuucuuuccgcagacgacucgcccga

SEQ ID NO: 14459 - RNA, 51 nt, Artificial Sequence
  Description of Artificial Sequence: Synthetic oligonucleotide
gggaggacgaugcgguuuuucuuuucccuuguccgcagacgacucgcccga

SEQ ID NO: 14460 - RNA, 50 nt, Artificial Sequence
  Description of Artificial Sequence: Synthetic oligonucleotide
gggaggacgaugcgguuucucuuuuucucuuccgcagacgacucgcccga

SEQ ID NO: 14461 - RNA, 51 nt, Artificial Sequence
  Description of Artificial Sequence: Synthetic oligonucleotide
gggaggacgaugcgguuuuuuuuccugcuuguccgcagacgacucgcccga

SEQ ID NO: 14462 - RNA, 51 nt, Artificial Sequence
  Description of Artificial Sequence: Synthetic oligonucleotide
gggaggacgaugcgguccuuucguuuugcccuccccagacgacucgcccga

SEQ ID NO: 14463 - RNA, 51 nt, Artificial Sequence
  Description of Artificial Sequence: Synthetic oligonucleotide
gggaggacgaugcgguuuguagggucauggguccgcagacgacucgcccga

SEQ ID NO: 14464 - RNA, 51 nt, Artificial Sequence
  Description of Artificial Sequence: Synthetic oligonucleotide
gggaggacgaugcgguuucaagggcgauggguccgcagacgacucgcccga

SEQ ID NO: 14465 - RNA, 51 nt, Artificial Sequence
  Description of Artificial Sequence: Synthetic oligonucleotide
gggaggacgaugcggucaucuuuuuacuuccugugcagacgacucgcccga

SEQ ID NO: 14466 - RNA, 50 nt, Artificial Sequence
  Description of Artificial Sequence: Synthetic oligonucleotide
gggaggacgaugcggauuuucuuuuugcuugccgcagacgacucgcccga

SEQ ID NO: 14467 - RNA, 50 nt, Artificial Sequence
  Description of Artificial Sequence: Synthetic oligonucleotide
gggaggacgaugcgguuuuuuuugucuugcuccgcagacgacucgcccga

SEQ ID NO: 14468 - RNA, 51 nt, Artificial Sequence
  Description of Artificial Sequence: Synthetic oligonucleotide
gggaggacgaugcggcuccauucuaucuuuuuccgcagacgacucgcccga

SEQ ID NO: 14469 - RNA, 51 nt, Artificial Sequence
  Description of Artificial Sequence: Synthetic oligonucleotide
gggaggacgaugcggauuccuuuuccuuuuuaccgcagacgacucgcccga

SEQ ID NO: 14470 - RNA, 50 nt, Artificial Sequence
  Description of Artificial Sequence: Synthetic oligonucleotide
gggaggacgaugcggauuucucuuuuuucugccgcagacgacucgcccga

SEQ ID NO: 14471 - RNA, 53 nt, Artificial Sequence
  Description of Artificial Sequence: Synthetic oligonucleotide
gggaggacgaugcgggaacucuuuuuuuuuuucgccccagacgacucgcccga

SEQ ID NO: 14472 - RNA, 51 nt, Artificial Sequence
  Description of Artificial Sequence: Synthetic oligonucleotide
gggaggacgaugcgguuugaaggguuuuggguccgcagacgacucgcccga

SEQ ID NO: 14473 - RNA, 52 nt, Artificial Sequence
  Description of Artificial Sequence: Synthetic oligonucleotide
gggaggacgaugcgguuucucuacguuuucuguccgcagacgacucgcccga

SEQ ID NO: 14474 - RNA, 51 nt, Artificial Sequence
  Description of Artificial Sequence: Synthetic oligonucleotide
gggaggacgaugcgguuauucuuguuuuaccccugcagacgacucgcccga

SEQ ID NO: 14475 - RNA, 52 nt, Artificial Sequence
  Description of Artificial Sequence: Synthetic oligonucleotide
gggaggacgaugcgguuuuuguucuuuuuucuuccgcagacgacucgcccga

SEQ ID NO: 14476 - RNA, 51 nt, Artificial Sequence
  Description of Artificial Sequence: Synthetic oligonucleotide
gggaggacgaugcggccuuuuguauuguuauuccgcagacgacucgcccga

SEQ ID NO: 14477 - RNA, 52 nt, Artificial Sequence
  Description of Artificial Sequence: Synthetic oligonucleotide
gggaggacgaugcggucugcucuuuuuuuuuccccccagacgacucgcccga

SEQ ID NO: 14478 - RNA, 52 nt, Artificial Sequence
  Description of Artificial Sequence: Synthetic oligonucleotide
gggaggacgaugcggaguuuuuuuaauuucuguccccagacgacucgcccga

SEQ ID NO: 14479 - RNA, 51 nt, Artificial Sequence
  Description of Artificial Sequence: Synthetic oligonucleotide
gggaggacgaugcggucacuaauucuuuucuuccgcagacgacucgcccga

SEQ ID NO: 14480 - RNA, 52 nt, Artificial Sequence
  Description of Artificial Sequence: Synthetic oligonucleotide
gggaggacgaugcgguuuucuacacuucuuuuuccgcagacgacucgcccga

SEQ ID NO: 14481 - RNA, 51 nt, Artificial Sequence
  Description of Artificial Sequence: Synthetic oligonucleotide
gggaggacgaugcgguuuuauccuucuacugcccgcagacgacucgcccga

SEQ ID NO: 14482 - RNA, 51 nt, Artificial Sequence
  Description of Artificial Sequence: Synthetic oligonucleotide
gggaggacgaugcgguuucuuuuuucuuacuugcccagacgacucgcccga

SEQ ID NO: 14483 - RNA, 53 nt, Artificial Sequence
  Description of Artificial Sequence: Synthetic oligonucleotide
gggaggacgaugcgguucuagcuucuuuuuuuguccgcagacgacucgcccga

SEQ ID NO: 14484 - RNA, 50 nt, Artificial Sequence
  Description of Artificial Sequence: Synthetic oligonucleotide
gggaggacgaugcgguuuuauuuucuuuuccccgcagacgacucgcccga

SEQ ID NO: 14485 - RNA, 51 nt, Artificial Sequence
  Description of Artificial Sequence: Synthetic oligonucleotide
gggaggacgaugcggacauucuuuauuuaccaccgcagacgacucgcccga

SEQ ID NO: 14486 - RNA, 51 nt, Artificial Sequence
  Description of Artificial Sequence: Synthetic oligonucleotide
gggaggacgaugcggucuuuuuguuuguuuugcuccagacgacucgcccga

SEQ ID NO: 14487 - RNA, 51 nt, Artificial Sequence
  Description of Artificial Sequence: Synthetic oligonucleotide
gggaggacgaugcgguuugugaguaggguguuccgcagacgacucgcccga

SEQ ID NO: 14488 - RNA, 52 nt, Artificial Sequence
  Description of Artificial Sequence: Synthetic oligonucleotide
gggaggacgaugcggucacaucuaauuuuuucuccgcagacgacucgcccga

SEQ ID NO: 14489 - RNA, 52 nt, Artificial Sequence
  Description of Artificial Sequence: Synthetic oligonucleotide
gggaggacgaugcgguuacuugguuauuuuuuucugcagacgacucgcccga

SEQ ID NO: 14490 - RNA, 52 nt, Artificial Sequence
  Description of Artificial Sequence: Synthetic oligonucleotide
gggaggacgaugcgguuugaagggugauaggguccucagacgacucgcccga

SEQ ID NO: 14491 - RNA, 50 nt, Artificial Sequence
  Description of Artificial Sequence: Synthetic oligonucleotide
gggaggacgaugcggcucauuucuucucuuuccgcagacgacucgcccga

SEQ ID NO: 14492 - RNA, 51 nt, Artificial Sequence
  Description of Artificial Sequence: Synthetic oligonucleotide
gggaggacgaugcgguuugaagggugauugggccgcagacgacucgcccga

SEQ ID NO: 14493 - RNA, 53 nt, Artificial Sequence
  Description of Artificial Sequence: Synthetic oligonucleotide
gggaggacgaugcggcuuucauuuuuuuuucguaccgcagacgacucgcccga

SEQ ID NO: 14494 - RNA, 52 nt, Artificial Sequence
  Description of Artificial Sequence: Synthetic oligonucleotide
gggaggacgaugcgguuuuuuguuuuguuuuuggugcagacgacucgcccga

SEQ ID NO: 14495 - RNA, 51 nt, Artificial Sequence
  Description of Artificial Sequence: Synthetic oligonucleotide
gggaggacgaugcgguuugggagucggguguuccgcagacgacucgcccga

SEQ ID NO: 14496 - RNA, 51 nt, Artificial Sequence
  Description of Artificial Sequence: Synthetic oligonucleotide
gggaggacgaugcgguuccuguguucucccugccccagacgacucgcccga

SEQ ID NO: 14497 - RNA, 51 nt, Artificial Sequence
  Description of Artificial Sequence: Synthetic oligonucleotide
gggaggacgaugcgggucuucuugcuuaucguccccagacgacucgcccga

SEQ ID NO: 14498 - RNA, 52 nt, Artificial Sequence
  Description of Artificial Sequence: Synthetic oligonucleotide
gggaggacgaugcgguuugaaggggugauggguccccagacgacucgcccga

SEQ ID NO: 14499 - RNA, 51 nt, Artificial Sequence
  Description of Artificial Sequence: Synthetic oligonucleotide
gggaggacgaugcgguauauguucgucacucgcugcagacgacucgcccga

SEQ ID NO: 14500 - RNA, 50 nt, Artificial Sequence
  Description of Artificial Sequence: Synthetic oligonucleotide
gggaggacgaugcggaaggguguaggguguuccgcagacgacucgcccga

SEQ ID NO: 14501 - RNA, 50 nt, Artificial Sequence
  Description of Artificial Sequence: Synthetic oligonucleotide
gggaggacgaugcggauuccuuuucucuuugccgcagacgacucgcccga

SEQ ID NO: 14502 - RNA, 51 nt, Artificial Sequence
  Description of Artificial Sequence: Synthetic oligonucleotide
gggaggacgaugcgguucucucccuguuguguccgcagacgacucgcccga

SEQ ID NO: 14503 - RNA, 51 nt, Artificial Sequence
  Description of Artificial Sequence: Synthetic oligonucleotide
gggaggacgaugcgguuugaaggggaauggguccgcagacgacucgcccga

SEQ ID NO: 14504 - RNA, 51 nt, Artificial Sequence
  Description of Artificial Sequence: Synthetic oligonucleotide
gggaggacgaugcggcuuuuucuuuucuuguuccgcagacgacucgcccga

SEQ ID NO: 14505 - RNA, 51 nt, Artificial Sequence
  Description of Artificial Sequence: Synthetic oligonucleotide
gggaggacgaugcggucuuuucauguuucccuccgcagacgacucgcccga

SEQ ID NO: 14506 - RNA, 51 nt, Artificial Sequence
  Description of Artificial Sequence: Synthetic oligonucleotide
gggaggacgaugcggucauuucuuuacuucuaccgcagacgacucgcccga

SEQ ID NO: 14507 - RNA, 50 nt, Artificial Sequence
  Description of Artificial Sequence: Synthetic oligonucleotide
gggaggacgaugcggauuuucucuuugcuugccgcagacgacucgcccga

SEQ ID NO: 14508 - RNA, 51 nt, Artificial Sequence
  Description of Artificial Sequence: Synthetic oligonucleotide
gggaggacgaugcggucacguauuuuuuacgggugcagacgacucgcccga

SEQ ID NO: 14509 - RNA, 51 nt, Artificial Sequence
  Description of Artificial Sequence: Synthetic oligonucleotide
gggaggacgaugcgguccugucgucuguccuuccccagacgacucgcccga

SEQ ID NO: 14510 - RNA, 50 nt, Artificial Sequence
  Description of Artificial Sequence: Synthetic oligonucleotide
gggaggacgaugcgggccuuucguuuugccuccccagacgacucgcccga

SEQ ID NO: 14511 - RNA, 52 nt, Artificial Sequence
  Description of Artificial Sequence: Synthetic oligonucleotide
gggaggacgaugcggguccugccgucuguucguccccagacgacucgcccga

SEQ ID NO: 14512 - RNA, 50 nt, Artificial Sequence
  Description of Artificial Sequence: Synthetic oligonucleotide
gggaggacgaugcgggccuucguucuacccuccccagacgacucgcccga

SEQ ID NO: 14513 - RNA, 51 nt, Artificial Sequence
  Description of Artificial Sequence: Synthetic oligonucleotide
gggaggacgaugcggcgauuucucugguucguccccagacgacucgcccga

SEQ ID NO: 14514 - RNA, 51 nt, Artificial Sequence
  Description of Artificial Sequence: Synthetic oligonucleotide
gggaggacgaugcggccagugaacuugaugugccccagacgacucgcccga

SEQ ID NO: 14515 - RNA, 50 nt, Artificial Sequence
  Description of Artificial Sequence: Synthetic oligonucleotide
gggaggacgaugcggcgauuccucuguucguccccagacgacucgcccga

SEQ ID NO: 14516 - RNA, 51 nt, Artificial Sequence
  Description of Artificial Sequence: Synthetic oligonucleotide
gggaggacgaugcggucuuuucauguuucucuccccagacgacucgcccga

SEQ ID NO: 14517 - RNA, 51 nt, Artificial Sequence
  Description of Artificial Sequence: Synthetic oligonucleotide
gggaggacgaugcgguccccugaguuucugcugcccagacgacucgcccga

SEQ ID NO: 14518 - RNA, 51 nt, Artificial Sequence
  Description of Artificial Sequence: Synthetic oligonucleotide
gggaggacgaugcggugguuuucucuucuuuugcccagacgacucgcccga

SEQ ID NO: 14519 - RNA, 52 nt, Artificial Sequence
  Description of Artificial Sequence: Synthetic oligonucleotide
gggaggacgaugcgguacuucuuuuuuuccucuccgcagacgacucgcccga

SEQ ID NO: 14520 - RNA, 51 nt, Artificial Sequence
  Description of Artificial Sequence: Synthetic oligonucleotide
gggaggacgaugcgguuuccuuuuucucuugucggcagacgacucgcccga

SEQ ID NO: 14521 - RNA, 51 nt, Artificial Sequence
  Description of Artificial Sequence: Synthetic oligonucleotide
gggaggacgaugcggguuuacuucuuucucugcugcagacgacucgcccga

SEQ ID NO: 14522 - RNA, 53 nt, Artificial Sequence
  Description of Artificial Sequence: Synthetic oligonucleotide
gggaggacgaugcggaauuauguuuuuuuugugaccucagacgacucgcccga

SEQ ID NO: 14523 - RNA, 51 nt, Artificial Sequence
  Description of Artificial Sequence: Synthetic oligonucleotide
gggaggacgaugcgguuuuauccuuuuccgcuccgcagacgacucgcccga

SEQ ID NO: 14524 - RNA, 51 nt, Artificial Sequence
  Description of Artificial Sequence: Synthetic oligonucleotide
gggaggacgaugcggcuuuuugauucuuguuuccgcagacgacucgcccga

SEQ ID NO: 14525 - RNA, 50 nt, Artificial Sequence
  Description of Artificial Sequence: Synthetic oligonucleotide
gggaggacgaugcggcucuuucuucuuuucuccgcagacgacucgcccga

SEQ ID NO: 14526 - RNA, 51 nt, Artificial Sequence
  Description of Artificial Sequence: Synthetic oligonucleotide
gggaggacgaugcgggccuuucguucuugccuccccagacgacucgcccga

SEQ ID NO: 14527 - RNA, 51 nt, Artificial Sequence
  Description of Artificial Sequence: Synthetic oligonucleotide
gggaggacgaugcgggcccugucgucuuacguccccagacgacucgcccga

SEQ ID NO: 14528 - RNA, 50 nt, Artificial Sequence
  Description of Artificial Sequence: Synthetic oligonucleotide
gggaggacgaugcggucuuuacuuucucuugccgcagacgacucgcccga

SEQ ID NO: 14529 - RNA, 51 nt, Artificial Sequence
  Description of Artificial Sequence: Synthetic oligonucleotide
gggaggacgaugcggacuuucauauuuuuccaccgcagacgacucgcccga

SEQ ID NO: 14530 - RNA, 50 nt, Artificial Sequence
  Description of Artificial Sequence: Synthetic oligonucleotide
gggaggacgaugcggcuuuucguucugcccuccccagacgacucgcccga

SEQ ID NO: 14531 - RNA, 51 nt, Artificial Sequence
  Description of Artificial Sequence: Synthetic oligonucleotide
gggaggacgaugcgguguuuauuuucuccgugccccagacgacucgcccga

SEQ ID NO: 14532 - RNA, 51 nt, Artificial Sequence
  Description of Artificial Sequence: Synthetic oligonucleotide
gggaggacgaugcggucuuuuuauucucucccccccagacgacucgcccga

SEQ ID NO: 14533 - RNA, 51 nt, Artificial Sequence
  Description of Artificial Sequence: Synthetic oligonucleotide
gggaggacgaugcggccuuugauccuuuuucuccgcagacgacucgcccga

SEQ ID NO: 14534 - RNA, 50 nt, Artificial Sequence
  Description of Artificial Sequence: Synthetic oligonucleotide
gggaggacgaugcgguuugggaguagggucuccgcagacgacucgcccga

SEQ ID NO: 14535 - RNA, 51 nt, Artificial Sequence
  Description of Artificial Sequence: Synthetic oligonucleotide
gggaggacgaugcggucucuuuacuuccuuuuccgcagacgacucgcccga

SEQ ID NO: 14536 - RNA, 51 nt, Artificial Sequence
  Description of Artificial Sequence: Synthetic oligonucleotide
gggaggacgaugcggugacucgucuuuuucguccccagacgacucgcccga

SEQ ID NO: 14537 - RNA, 51 nt, Artificial Sequence
  Description of Artificial Sequence: Synthetic oligonucleotide
gggaggacgaugcggauucucuucucuuuucaccgcagacgacucgcccga

SEQ ID NO: 14538 - RNA, 51 nt, Artificial Sequence
  Description of Artificial Sequence: Synthetic oligonucleotide
gggaggacgaugcggcgcuuuucuuacuucuuccgcagacgacucgcccga

SEQ ID NO: 14539 - RNA, 50 nt, Artificial Sequence
  Description of Artificial Sequence: Synthetic oligonucleotide
gggaggacgaugcggcuuucucuugcucuuuccgcagacgacucgcccga

SEQ ID NO: 14540 - RNA, 50 nt, Artificial Sequence
  Description of Artificial Sequence: Synthetic oligonucleotide
gggaggacgaugcgguuuacuuuuacucuugccccagacgacucgcccga

SEQ ID NO: 14541 - RNA, 51 nt, Artificial Sequence
  Description of Artificial Sequence: Synthetic oligonucleotide
gggaggacgaugcggcuuuauuauccuuuuuuccccagacgacucgcccga

SEQ ID NO: 14542 - RNA, 51 nt, Artificial Sequence
  Description of Artificial Sequence: Synthetic oligonucleotide
gggaggacgaugcggcucuuuauuuccuugccccgcagacgacucgcccga

SEQ ID NO: 14543 - RNA, 50 nt, Artificial Sequence
  Description of Artificial Sequence: Synthetic oligonucleotide
gggaggacgaugcgguuucuuugcuuucucuccgcagacgacucgcccga

SEQ ID NO: 14544 - RNA, 51 nt, Artificial Sequence
  Description of Artificial Sequence: Synthetic oligonucleotide
gggaggacgaugcggauuuccccuuucuuuugccgcagacgacucgcccga

SEQ ID NO: 14545 - RNA, 49 nt, Artificial Sequence
  Description of Artificial Sequence: Synthetic oligonucleotide
gggaggacgaugcgguuugggguuuucgugccgcagacgacucgcccga

SEQ ID NO: 14546 - RNA, 50 nt, Artificial Sequence
  Description of Artificial Sequence: Synthetic oligonucleotide
gggaggacgaugcggauccuuuugcuuucuaccgcagacgacucgcccga

SEQ ID NO: 14547 - RNA, 51 nt, Artificial Sequence
  Description of Artificial Sequence: Synthetic oligonucleotide
gggaggacgaugcgguccuuuauuguuuucuccugcagacgacucgcccga

SEQ ID NO: 14548 - RNA, 51 nt, Artificial Sequence
  Description of Artificial Sequence: Synthetic oligonucleotide
gggaggacgaugcgguauucuucuauaccucuccgcagacgacucgcccga

SEQ ID NO: 14549 - RNA, 52 nt, Artificial Sequence
  Description of Artificial Sequence: Synthetic oligonucleotide
gggaggacgaugcggguuuccuuguuucuuguuccgcagacgacucgcccga

SEQ ID NO: 14550 - RNA, 51 nt, Artificial Sequence
  Description of Artificial Sequence: Synthetic oligonucleotide
gggaggacgaugcggcuuuuccagucuuuuucccgcagacgacucgcccga

SEQ ID NO: 14551 - RNA, 51 nt, Artificial Sequence
  Description of Artificial Sequence: Synthetic oligonucleotide
gggaggacgaugcgguuucucuugcuuacuccccgcagacgacucgcccga

SEQ ID NO: 14552 - RNA, 51 nt, Artificial Sequence
  Description of Artificial Sequence: Synthetic oligonucleotide
gggaggacgaugcggauugaagggugauggguccccagacgacucgcccga

SEQ ID NO: 14553 - RNA, 51 nt, Artificial Sequence
  Description of Artificial Sequence: Synthetic oligonucleotide
gggaggacgaugcgguuuggggucuucccgugccgcagacgacucgcccga

SEQ ID NO: 14554 - RNA, 51 nt, Artificial Sequence
  Description of Artificial Sequence: Synthetic oligonucleotide
gggaggacgaugcgggccuuucgcucuacccuccccagacgacucgcccga

SEQ ID NO: 14555 - RNA, 51 nt, Artificial Sequence
  Description of Artificial Sequence: Synthetic oligonucleotide
gggaggacgaugcgggucuuuuggcuuaucguccccagacgacucgcccga

SEQ ID NO: 14556 - RNA, 50 nt, Artificial Sequence
  Description of Artificial Sequence: Synthetic oligonucleotide
gggaggacgaugcggauucuuuucucuuucaccgcagacgacucgcccga

SEQ ID NO: 14557 - RNA, 53 nt, Artificial Sequence
  Description of Artificial Sequence: Synthetic oligonucleotide
gggaggacgaugcggcuuuuccuuuuuuuucacuccgcagacgacucgcccga

SEQ ID NO: 14558 - RNA, 51 nt, Artificial Sequence
  Description of Artificial Sequence: Synthetic oligonucleotide
gggaggacgaugcggucuuuacuuuuucuuugccgcagacgacucgcccga

SEQ ID NO: 14559 - RNA, 51 nt, Artificial Sequence
  Description of Artificial Sequence: Synthetic oligonucleotide
gggaggacgaugcgguuugaagggacauggguccgcagacgacucgcccga

SEQ ID NO: 14560 - RNA, 50 nt, Artificial Sequence
  Description of Artificial Sequence: Synthetic oligonucleotide
gggaggacgaugcggcuuucacuuuuucucuccgcagacgacucgcccga

SEQ ID NO: 14561 - RNA, 51 nt, Artificial Sequence
  Description of Artificial Sequence: Synthetic oligonucleotide
gggaggacgaugcgguuugcaggguguuggguccgcagacgacucgcccga

SEQ ID NO: 14562 - RNA, 51 nt, Artificial Sequence
  Description of Artificial Sequence: Synthetic oligonucleotide
gggaggacgaugcggauccuuucuuucuucugccgcagacgacucgcccga

SEQ ID NO: 14563 - RNA, 51 nt, Artificial Sequence
  Description of Artificial Sequence: Synthetic oligonucleotide
gggaggacgaugcggucuuuucaugucucucuccgcagacgacucgcccga

SEQ ID NO: 14564 - RNA, 51 nt, Artificial Sequence
  Description of Artificial Sequence: Synthetic oligonucleotide
gggaggacgaugcgguuugaaggguauuggguccgcagacgacucgcccga

SEQ ID NO: 14565 - RNA, 51 nt, Artificial Sequence
  Description of Artificial Sequence: Synthetic oligonucleotide
gggaggacgaugcgguguuauuucccucuucuccgcagacgacucgcccga

SEQ ID NO: 14566 - RNA, 51 nt, Artificial Sequence
  Description of Artificial Sequence: Synthetic oligonucleotide
gggaggacgaugcgggccuuucguucuuuccuccccagacgacucgcccga

SEQ ID NO: 14567 - RNA, 51 nt, Artificial Sequence
  Description of Artificial Sequence: Synthetic oligonucleotide
gggaggacgaugcgguucuuuucucagcucuuccgcagacgacucgcccga

SEQ ID NO: 14568 - RNA, 50 nt, Artificial Sequence
  Description of Artificial Sequence: Synthetic oligonucleotide
gggaggacgaugcggcucuuuuucccuuucuccgcagacgacucgcccga

SEQ ID NO: 14569 - RNA, 51 nt, Artificial Sequence
  Description of Artificial Sequence: Synthetic oligonucleotide
gggaggacgaugcgguguuuuguucucccuggccgcagacgacucgcccga

SEQ ID NO: 14570 - RNA, 51 nt, Artificial Sequence
  Description of Artificial Sequence: Synthetic oligonucleotide
gggaggacgaugcggcuuggagggugauggguccgcagacgacucgcccga

SEQ ID NO: 14571 - RNA, 49 nt, Artificial Sequence
  Description of Artificial Sequence: Synthetic oligonucleotide
gggaggacgaugcggucuuuucuucucuuaccgcagacgacucgcccga

SEQ ID NO: 14572 - RNA, 51 nt, Artificial Sequence
  Description of Artificial Sequence: Synthetic oligonucleotide
gggaggacgaugcggaguuguuuaauuuguuugcccagacgacucgcccga

SEQ ID NO: 14573 - RNA, 51 nt, Artificial Sequence
  Description of Artificial Sequence: Synthetic oligonucleotide
gggaggacgaugcgguuuccuuucaccuuuccccccagacgacucgcccga

SEQ ID NO: 14574 - RNA, 52 nt, Artificial Sequence
  Description of Artificial Sequence: Synthetic oligonucleotide
gggaggacgaugcggauucuguuuuucuuguuaccgcagacgacucgcccga

SEQ ID NO: 14575 - RNA, 51 nt, Artificial Sequence
  Description of Artificial Sequence: Synthetic oligonucleotide
gggaggacgaugcggauuucuucuccucuucuccgcagacgacucgcccga

SEQ ID NO: 14576 - RNA, 51 nt, Artificial Sequence
  Description of Artificial Sequence: Synthetic oligonucleotide
gggaggacgaugcgguuuuauuacuuuucccuggccagacgacucgcccga

SEQ ID NO: 14577 - RNA, 49 nt, Artificial Sequence
  Description of Artificial Sequence: Synthetic oligonucleotide
gggaggacgaugcgguugaagggugaugguccgcagacgacucgcccga

SEQ ID NO: 14578 - RNA, 50 nt, Artificial Sequence
  Description of Artificial Sequence: Synthetic oligonucleotide
gggaggacgaugcgguucauuucuuuucucuccgcagacgacucgcccga

SEQ ID NO: 14579 - RNA, 52 nt, Artificial Sequence
  Description of Artificial Sequence: Synthetic oligonucleotide
gggaggacgaugcgguuugggaguaggguguuuccgcagacgacucgcccga

SEQ ID NO: 14580 - RNA, 51 nt, Artificial Sequence
  Description of Artificial Sequence: Synthetic oligonucleotide
gggaggacgaugcggcauuuucuguuuuuucggcccagacgacucgcccga

SEQ ID NO: 14581 - RNA, 50 nt, Artificial Sequence
  Description of Artificial Sequence: Synthetic oligonucleotide
gggaggacgaugcgguuuaucaaguuuuuuuccgcagacgacucgcccga

SEQ ID NO: 14582 - RNA, 51 nt, Artificial Sequence
  Description of Artificial Sequence: Synthetic oligonucleotide
gggaggacgaugcgguuugucuuuguuuuuguccgcagacgacucgcccga

SEQ ID NO: 14583 - RNA, 53 nt, Artificial Sequence
  Description of Artificial Sequence: Synthetic oligonucleotide
gggaggacgaugcgguuauugcuuuuuuuuugguccgcagacgacucgcccga

SEQ ID NO: 14584 - RNA, 50 nt, Artificial Sequence
  Description of Artificial Sequence: Synthetic oligonucleotide
gggaggacgaugcgguuuauuuucuguuguugugcagacgacucgcccga

SEQ ID NO: 14585 - RNA, 51 nt, Artificial Sequence
  Description of Artificial Sequence: Synthetic oligonucleotide
gggaggacgaugcgggcugguguagggggguuccgcagacgacucgcccga

SEQ ID NO: 14586 - RNA, 51 nt, Artificial Sequence
  Description of Artificial Sequence: Synthetic oligonucleotide
gggaggacgaugcggccauucuuucucugcuuccgcagacgacucgcccga

SEQ ID NO: 14587 - RNA, 51 nt, Artificial Sequence
  Description of Artificial Sequence: Synthetic oligonucleotide
gggaggacgaugcggcuuguuucuuccuauuaccgcagacgacucgcccga

SEQ ID NO: 14588 - RNA, 51 nt, Artificial Sequence
  Description of Artificial Sequence: Synthetic oligonucleotide
gggaggacgaugcgguauuuacguucuauucuccgcagacgacucgcccga

SEQ ID NO: 14589 - RNA, 51 nt, Artificial Sequence
  Description of Artificial Sequence: Synthetic oligonucleotide
gggaggacgaugcggucuuuauuacauucuuugcgcagacgacucgcccga

SEQ ID NO: 14590 - RNA, 51 nt, Artificial Sequence
  Description of Artificial Sequence: Synthetic oligonucleotide
gggaggacgaugcgguucuuguuuuuacucauccccagacgacucgcccga

SEQ ID NO: 14591 - RNA, 51 nt, Artificial Sequence
  Description of Artificial Sequence: Synthetic oligonucleotide
gggaggacgaugcggcuuacauuucccuuuuuccgcagacgacucgcccga

SEQ ID NO: 14592 - RNA, 51 nt, Artificial Sequence
  Description of Artificial Sequence: Synthetic oligonucleotide
gggaggacgaugcgguacuauaucuuuuuucgcugcagacgacucgcccga

SEQ ID NO: 14593 - RNA, 53 nt, Artificial Sequence
  Description of Artificial Sequence: Synthetic oligonucleotide
gggaggacgaugcggauugcguacuuuuuuuuuuccgcagacgacucgcccga

SEQ ID NO: 14594 - RNA, 51 nt, Artificial Sequence
  Description of Artificial Sequence: Synthetic oligonucleotide
gggaggacgaugcggauucuuuaacucucuucccgcagacgacucgcccga

SEQ ID NO: 14595 - RNA, 52 nt, Artificial Sequence
  Description of Artificial Sequence: Synthetic oligonucleotide
gggaggacgaugcggaauuugcuucuuuuuuauccgcagacgacucgcccga

SEQ ID NO: 14596 - RNA, 51 nt, Artificial Sequence
  Description of Artificial Sequence: Synthetic oligonucleotide
gggaggacgaugcgguguucuauucgcucuuuccgcagacgacucgcccga

SEQ ID NO: 14597 - RNA, 51 nt, Artificial Sequence
  Description of Artificial Sequence: Synthetic oligonucleotide
gggaggacgaugcggauuacuuaccuucuuuugcccagacgacucgcccga

SEQ ID NO: 14598 - RNA, 51 nt, Artificial Sequence
  Description of Artificial Sequence: Synthetic oligonucleotide
gggaggacgaugcggcuucguuaaauuuuccuccgcagacgacucgcccga

SEQ ID NO: 14599 - RNA, 51 nt, Artificial Sequence
  Description of Artificial Sequence: Synthetic oligonucleotide
gggaggacgaugcggcucuuuguuuuuucuugcugcagacgacucgcccga

SEQ ID NO: 14600 - RNA, 51 nt, Artificial Sequence
  Description of Artificial Sequence: Synthetic oligonucleotide
gggaggacgaugcgggaaggaggaguugggaucugcagacgacucgcccga

SEQ ID NO: 14601 - RNA, 50 nt, Artificial Sequence
  Description of Artificial Sequence: Synthetic oligonucleotide
gggaggacgaugcggucuuuuucauuuguuuccccagacgacucgcccga

SEQ ID NO: 14602 - RNA, 51 nt, Artificial Sequence
  Description of Artificial Sequence: Synthetic oligonucleotide
gggaggacgaugcgguuuacuauuuuauugccccgcagacgacucgcccga

SEQ ID NO: 14603 - RNA, 51 nt, Artificial Sequence
  Description of Artificial Sequence: Synthetic oligonucleotide
gggaggacgaugcgguaccuuuguaauuuuuuccgcagacgacucgcccga

SEQ ID NO: 14604 - RNA, 51 nt, Artificial Sequence
  Description of Artificial Sequence: Synthetic oligonucleotide
gggaggacgaugcgggcuuuuuacauuucucaccccagacgacucgcccga

SEQ ID NO: 14605 - RNA, 51 nt, Artificial Sequence
  Description of Artificial Sequence: Synthetic oligonucleotide
gggaggacgaugcgggauuucuccucuuuuauccgcagacgacucgcccga

SEQ ID NO: 14606 - RNA, 51 nt, Artificial Sequence
  Description of Artificial Sequence: Synthetic oligonucleotide
gggaggacgaugcggcuuuucaauuccuuuuaccccagacgacucgcccga

SEQ ID NO: 14607 - RNA, 51 nt, Artificial Sequence
  Description of Artificial Sequence: Synthetic oligonucleotide
gggaggacgaugcgguuuucauuuuauccucugugcagacgacucgcccga

SEQ ID NO: 14608 - RNA, 52 nt, Artificial Sequence
  Description of Artificial Sequence: Synthetic oligonucleotide
gggaggacgaugcggucuuuuuuuguuuuucugccucagacgacucgcccga

SEQ ID NO: 14609 - RNA, 52 nt, Artificial Sequence
  Description of Artificial Sequence: Synthetic oligonucleotide
gggaggacgaugcggacaucuuuuuuucuuuugcgccagacgacucgcccga

SEQ ID NO: 14610 - RNA, 51 nt, Artificial Sequence
  Description of Artificial Sequence: Synthetic oligonucleotide
gggaggacgaugcgguuuucucaauuuauuucccgcagacgacucgcccga

SEQ ID NO: 14611 - RNA, 51 nt, Artificial Sequence
  Description of Artificial Sequence: Synthetic oligonucleotide
gggaggacgaugcggauuucaucuuuacuucucugcagacgacucgcccga

SEQ ID NO: 14612 - RNA, 51 nt, Artificial Sequence
  Description of Artificial Sequence: Synthetic oligonucleotide
gggaggacgaugcggauuuucauuucccuuuaccgcagacgacucgcccga

SEQ ID NO: 14613 - RNA, 51 nt, Artificial Sequence
  Description of Artificial Sequence: Synthetic oligonucleotide
gggaggacgaugcggcuuuuuacuauccuuuucugcagacgacucgcccga

SEQ ID NO: 14614 - RNA, 51 nt, Artificial Sequence
  Description of Artificial Sequence: Synthetic oligonucleotide
gggaggacgaugcgguuauuucuucuaccccuccgcagacgacucgcccga

SEQ ID NO: 14615 - RNA, 52 nt, Artificial Sequence
  Description of Artificial Sequence: Synthetic oligonucleotide
gggaggacgaugcggucuaauuuuuaccuccuuccgcagacgacucgcccga

SEQ ID NO: 14616 - RNA, 51 nt, Artificial Sequence
  Description of Artificial Sequence: Synthetic oligonucleotide
gggaggacgaugcggcuuucaacuuuuuuccgcgucagacgacucgcccga

SEQ ID NO: 14617 - RNA, 51 nt, Artificial Sequence
  Description of Artificial Sequence: Synthetic oligonucleotide
gggaggacgaugcggauuuauuuuugcccuuaccacagacgacucgcccga

SEQ ID NO: 14618 - RNA, 51 nt, Artificial Sequence
  Description of Artificial Sequence: Synthetic oligonucleotide
gggaggacgaugcgguuuuucuuuaauuugugccccagacgacucgcccga

SEQ ID NO: 14619 - RNA, 51 nt, Artificial Sequence
  Description of Artificial Sequence: Synthetic oligonucleotide
gggaggacgaugcggcauucacuauucuuuuuccgcagacgacucgcccga

SEQ ID NO: 14620 - RNA, 51 nt, Artificial Sequence
  Description of Artificial Sequence: Synthetic oligonucleotide
gggaggacgaugcgguucuuauauuccgcuucccgcagacgacucgcccga

SEQ ID NO: 14621 - RNA, 51 nt, Artificial Sequence
  Description of Artificial Sequence: Synthetic oligonucleotide
gggaggacgaugcgguauuuuuccuuuucuggccccagacgacucgcccga

SEQ ID NO: 14622 - RNA, 51 nt, Artificial Sequence
  Description of Artificial Sequence: Synthetic oligonucleotide
gggaggacgaugcggguuuccuuuagucuuuuccgcagacgacucgcccga

SEQ ID NO: 14623 - RNA, 51 nt, Artificial Sequence
  Description of Artificial Sequence: Synthetic oligonucleotide
gggaggacgaugcgguucauuuauuuuacuuugcccagacgacucgcccga

SEQ ID NO: 14624 - RNA, 51 nt, Artificial Sequence
  Description of Artificial Sequence: Synthetic oligonucleotide
gggaggacgaugcgguaucuuguuauuucuuccugcagacgacucgcccga

SEQ ID NO: 14625 - RNA, 51 nt, Artificial Sequence
  Description of Artificial Sequence: Synthetic oligonucleotide
gggaggacgaugcgguuucuuuuuaguucuuuccgcagacgacucgcccga

SEQ ID NO: 14626 - RNA, 53 nt, Artificial Sequence
  Description of Artificial Sequence: Synthetic oligonucleotide
gggaggacgaugcgguuauaugucuuuuuuuugucugcagacgacucgcccga

SEQ ID NO: 14627 - RNA, 51 nt, Artificial Sequence
  Description of Artificial Sequence: Synthetic oligonucleotide
gggaggacgaugcgggacuuuacucuucuuuuccccagacgacucgcccga

SEQ ID NO: 14628 - RNA, 51 nt, Artificial Sequence
  Description of Artificial Sequence: Synthetic oligonucleotide
gggaggacgaugcggaucucuuugcucuuauaccgcagacgacucgcccga

SEQ ID NO: 14629 - RNA, 51 nt, Artificial Sequence
  Description of Artificial Sequence: Synthetic oligonucleotide
gggaggacgaugcgguuuacaauuuucucuugccgcagacgacucgcccga

SEQ ID NO: 14630 - RNA, 51 nt, Artificial Sequence
  Description of Artificial Sequence: Synthetic oligonucleotide
gggaggacgaugcggacuucuauuucucucuugcccagacgacucgcccga

SEQ ID NO: 14631 - RNA, 51 nt, Artificial Sequence
  Description of Artificial Sequence: Synthetic oligonucleotide
gggaggacgaugcggucuuuauucugucuucucugcagacgacucgcccga

SEQ ID NO: 14632 - RNA, 51 nt, Artificial Sequence
  Description of Artificial Sequence: Synthetic oligonucleotide
gggaggacgaugcggcuuacuuauaucuuucuccgcagacgacucgcccga

SEQ ID NO: 14633 - RNA, 51 nt, Artificial Sequence
  Description of Artificial Sequence: Synthetic oligonucleotide
gggaggacgaugcggccuuuucauuucucuuccugcagacgacucgcccga

SEQ ID NO: 14634 - RNA, 52 nt, Artificial Sequence
  Description of Artificial Sequence: Synthetic oligonucleotide
gggaggacgaugcgguauuuauuuuuucuugccccucagacgacucgcccga

SEQ ID NO: 14635 - RNA, 51 nt, Artificial Sequence
  Description of Artificial Sequence: Synthetic oligonucleotide
gggaggacgaugcggcuuuauuuuaauuccccccgcagacgacucgcccga

SEQ ID NO: 14636 - RNA, 51 nt, Artificial Sequence
  Description of Artificial Sequence: Synthetic oligonucleotide
gggaggacgaugcggcauaggaguagggcgguagccagacgacucgcccga

SEQ ID NO: 14637 - RNA, 51 nt, Artificial Sequence
  Description of Artificial Sequence: Synthetic oligonucleotide
gggaggacgaugcgguuuuaugcuuuuaccuuccgcagacgacucgcccga

SEQ ID NO: 14638 - RNA, 51 nt, Artificial Sequence
  Description of Artificial Sequence: Synthetic oligonucleotide
gggaggacgaugcggcuacauacuuucuucuuccgcagacgacucgcccga

SEQ ID NO: 14639 - RNA, 49 nt, Artificial Sequence
  Description of Artificial Sequence: Synthetic oligonucleotide
gggaggacgaugcggccuuuuguaaucuuuccgcagacgacucgcccga

SEQ ID NO: 14640 - RNA, 51 nt, Artificial Sequence
  Description of Artificial Sequence: Synthetic oligonucleotide
gggaggacgaugcgggccuuuuguaauuuuuuccccagacgacucgcccga

SEQ ID NO: 14641 - RNA, 52 nt, Artificial Sequence
  Description of Artificial Sequence: Synthetic oligonucleotide
gggaggacgaugcggauuuguuauguuuuuguaccgcagacgacucgcccga

SEQ ID NO: 14642 - RNA, 51 nt, Artificial Sequence
  Description of Artificial Sequence: Synthetic oligonucleotide
gggaggacgaugcgguuuauuuauuuuacucuccacagacgacucgcccga

SEQ ID NO: 14643 - RNA, 51 nt, Artificial Sequence
  Description of Artificial Sequence: Synthetic oligonucleotide
gggaggacgaugcggucuucacuuuuuauguuccgcagacgacucgcccga

SEQ ID NO: 14644 - RNA, 53 nt, Artificial Sequence
  Description of Artificial Sequence: Synthetic oligonucleotide
gggaggacgaugcgguuucccuuuuuguuacuugccgcagacgacucgcccga

SEQ ID NO: 14645 - RNA, 51 nt, Artificial Sequence
  Description of Artificial Sequence: Synthetic oligonucleotide
gggaggacgaugcgguuguacucuucucuuucccgcagacgacucgcccga

SEQ ID NO: 14646 - RNA, 51 nt, Artificial Sequence
  Description of Artificial Sequence: Synthetic oligonucleotide
gggaggacgaugcggaucuauacuuacucucaccgcagacgacucgcccga

SEQ ID NO: 14647 - RNA, 53 nt, Artificial Sequence
  Description of Artificial Sequence: Synthetic oligonucleotide
gggaggacgaugcgguuuguuuauucuuuuuuuuccgcagacgacucgcccga

SEQ ID NO: 14648 - RNA, 51 nt, Artificial Sequence
  Description of Artificial Sequence: Synthetic oligonucleotide
gggaggacgaugcggauuucaucuuucuuuugccacagacgacucgcccga

SEQ ID NO: 14649 - RNA, 51 nt, Artificial Sequence
  Description of Artificial Sequence: Synthetic oligonucleotide
gggaggacgaugcggaugugguguuugcuuagcugcagacgacucgcccga

SEQ ID NO: 14650 - RNA, 51 nt, Artificial Sequence
  Description of Artificial Sequence: Synthetic oligonucleotide
gggaggacgaugcgguuuuuugauuuuccggucugcagacgacucgcccga

SEQ ID NO: 14651 - RNA, 51 nt, Artificial Sequence
  Description of Artificial Sequence: Synthetic oligonucleotide
gggaggacgaugcggaucuuucacuauucacuccgcagacgacucgcccga

SEQ ID NO: 14652 - RNA, 50 nt, Artificial Sequence
  Description of Artificial Sequence: Synthetic oligonucleotide
gggaggacgaugcgguccugucgucuguucuucccagacgacucgcccga

SEQ ID NO: 14653 - RNA, 49 nt, Artificial Sequence
  Description of Artificial Sequence: Synthetic oligonucleotide
gggaggacgaugcgggccuuucgucucccuccccagacgacucgcccga

SEQ ID NO: 14654 - RNA, 51 nt, Artificial Sequence
  Description of Artificial Sequence: Synthetic oligonucleotide
gggaggacgaugcggugauuccucugguucguccccagacgacucgcccga

SEQ ID NO: 14655 - RNA, 51 nt, Artificial Sequence
  Description of Artificial Sequence: Synthetic oligonucleotide
gggaggacgaugcgggccuuucggucuacccuccccagacgacucgcccga

SEQ ID NO: 14656 - RNA, 52 nt, Artificial Sequence
  Description of Artificial Sequence: Synthetic oligonucleotide
gggaggacgaugcgggccuuucguucugcaccuccccagacgacucgcccga

SEQ ID NO: 14657 - RNA, 51 nt, Artificial Sequence
  Description of Artificial Sequence: Synthetic oligonucleotide
gggaggacgaugcgguuuggagggugcuggguccgcagacgacucgcccga

SEQ ID NO: 14658 - RNA, 51 nt, Artificial Sequence
  Description of Artificial Sequence: Synthetic oligonucleotide
gggaggacgaugcggcuucauuccuuucacuaccgcagacgacucgcccga

SEQ ID NO: 14659 - RNA, 50 nt, Artificial Sequence
  Description of Artificial Sequence: Synthetic oligonucleotide
gggaggacgaugcggucuuuuucuacccuuuccgcagacgacucgcccga

SEQ ID NO: 14660 - RNA, 51 nt, Artificial Sequence
  Description of Artificial Sequence: Synthetic oligonucleotide
gggaggacgaugcgguaaggaggaguuggggaccgcagacgacucgcccga

SEQ ID NO: 14661 - RNA, 51 nt, Artificial Sequence
  Description of Artificial Sequence: Synthetic oligonucleotide
gggaggacgaugcggucccuuuuaccuuuuccccgcagacgacucgcccga

SEQ ID NO: 14662 - RNA, 52 nt, Artificial Sequence
  Description of Artificial Sequence: Synthetic oligonucleotide
gggaggacgaugcgguuuuuuucacuuuucccucugcagacgacucgcccga

SEQ ID NO: 14663 - RNA, 51 nt, Artificial Sequence
  Description of Artificial Sequence: Synthetic oligonucleotide
gggaggacgaugcgguacuuucacuugccuuuccgcagacgacucgcccga

SEQ ID NO: 14664 - RNA, 51 nt, Artificial Sequence
  Description of Artificial Sequence: Synthetic oligonucleotide
gggaggacgaugcgguguuuuauaguucuguuccgcagacgacucgcccga

SEQ ID NO: 14665 - RNA, 51 nt, Artificial Sequence
  Description of Artificial Sequence: Synthetic oligonucleotide
gggaggacgaugcggacuuuuuuauuuuuuaccugcagacgacucgcccga

SEQ ID NO: 14666 - RNA, 51 nt, Artificial Sequence
  Description of Artificial Sequence: Synthetic oligonucleotide
gggaggacgaugcgguucuuguuuucucuaucccccagacgacucgcccga

SEQ ID NO: 14667 - RNA, 51 nt, Artificial Sequence
  Description of Artificial Sequence: Synthetic oligonucleotide
gggaggacgaugcggacuuuccuuuguuuccaccgcagacgacucgcccga

SEQ ID NO: 14668 - RNA, 51 nt, Artificial Sequence
  Description of Artificial Sequence: Synthetic oligonucleotide
gggaggacgaugcggcauuguucguuuuuucucgccagacgacucgcccga

SEQ ID NO: 14669 - RNA, 50 nt, Artificial Sequence
  Description of Artificial Sequence: Synthetic oligonucleotide
gggaggacgaugcgguuucucuuuucucuuuccgcagacgacucgcccga

SEQ ID NO: 14670 - RNA, 51 nt, Artificial Sequence
  Description of Artificial Sequence: Synthetic oligonucleotide
gggaggacgaugcggcucauucuuauuuauuuccgcagacgacucgcccga

SEQ ID NO: 14671 - RNA, 53 nt, Artificial Sequence
  Description of Artificial Sequence: Synthetic oligonucleotide
gggaggacgaugcgguauuuugucacuuuuuuuuccgcagacgacucgcccga

SEQ ID NO: 14672 - RNA, 51 nt, Artificial Sequence
  Description of Artificial Sequence: Synthetic oligonucleotide
gggaggacgaugcgguuuguuuuucuuuuuuuccgcagacgacucgcccga

SEQ ID NO: 14673 - RNA, 51 nt, Artificial Sequence
  Description of Artificial Sequence: Synthetic oligonucleotide
gggaggacgaugcggcuucuuuuacuuucuuuccgcagacgacucgcccga

SEQ ID NO: 14674 - RNA, 51 nt, Artificial Sequence
  Description of Artificial Sequence: Synthetic oligonucleotide
gggaggacgaugcggugucguaguuuauccgcccgcagacgacucgcccga

SEQ ID NO: 14675 - RNA, 51 nt, Artificial Sequence
  Description of Artificial Sequence: Synthetic oligonucleotide
gggaggacgaugcggcgacucgaucugcucguccccagacgacucgcccga

SEQ ID NO: 14676 - RNA, 51 nt, Artificial Sequence
  Description of Artificial Sequence: Synthetic oligonucleotide
gggaggacgaugcgggcuuuucguucugccuuccccagacgacucgcccga

SEQ ID NO: 14677 - RNA, 51 nt, Artificial Sequence
  Description of Artificial Sequence: Synthetic oligonucleotide
gggaggacgaugcgguucuuuacuaacucuugccgcagacgacucgcccga

SEQ ID NO: 14678 - RNA, 52 nt, Artificial Sequence
  Description of Artificial Sequence: Synthetic oligonucleotide
gggaggacgaugcggauuugcuuuuuuuugauuccgcagacgacucgcccga

SEQ ID NO: 14679 - RNA, 51 nt, Artificial Sequence
  Description of Artificial Sequence: Synthetic oligonucleotide
gggaggacgaugcgguucuuuacuuuuucccuccgcagacgacucgcccga

SEQ ID NO: 14680 - RNA, 51 nt, Artificial Sequence
  Description of Artificial Sequence: Synthetic oligonucleotide
gggaggacgaugcggaucuuuauuuucucucuccgcagacgacucgcccga

SEQ ID NO: 14681 - RNA, 51 nt, Artificial Sequence
  Description of Artificial Sequence: Synthetic oligonucleotide
gggaggacgaugcgguuugacgggugauggggccgcagacgacucgcccga

SEQ ID NO: 14682 - RNA, 51 nt, Artificial Sequence
  Description of Artificial Sequence: Synthetic oligonucleotide
gggaggacgaugcgguuuucuugccuuuuuuuccgcagacgacucgcccga

SEQ ID NO: 14683 - RNA, 50 nt, Artificial Sequence
  Description of Artificial Sequence: Synthetic oligonucleotide
gggaggacgaugcgguuauuuuccuuuuuugccgcagacgacucgcccga

SEQ ID NO: 14684 - RNA, 51 nt, Artificial Sequence
  Description of Artificial Sequence: Synthetic oligonucleotide
gggaggacgaugcggauuuucucuuuuuuccgccgcagacgacucgcccga

SEQ ID NO: 14685 - RNA, 51 nt, Artificial Sequence
  Description of Artificial Sequence: Synthetic oligonucleotide
gggaggacgaugcgguuuggaggguguuggguccgcagacgacucgcccga

SEQ ID NO: 14686 - RNA, 52 nt, Artificial Sequence
  Description of Artificial Sequence: Synthetic oligonucleotide
gggaggacgaugcggauuccuacuuuuuuuuccccgcagacgacucgcccga

SEQ ID NO: 14687 - RNA, 51 nt, Artificial Sequence
  Description of Artificial Sequence: Synthetic oligonucleotide
gggaggacgaugcggaacuuuauuuacuuuucccccagacgacucgcccga

SEQ ID NO: 14688 - RNA, 51 nt, Artificial Sequence
  Description of Artificial Sequence: Synthetic oligonucleotide
gggaggacgaugcggugucacuuuuuuccuuuccgcagacgacucgcccga

SEQ ID NO: 14689 - RNA, 51 nt, Artificial Sequence
  Description of Artificial Sequence: Synthetic oligonucleotide
gggaggacgaugcgguuucuuauucuuucuuucugcagacgacucgcccga

SEQ ID NO: 14690 - RNA, 50 nt, Artificial Sequence
  Description of Artificial Sequence: Synthetic oligonucleotide
gggaggacgaugcggucuuuuguuucuuuauccgcagacgacucgcccga

SEQ ID NO: 14691 - RNA, 53 nt, Artificial Sequence
  Description of Artificial Sequence: Synthetic oligonucleotide
gggaggacgaugcggucuuuuuuuuucacuuucuccgcagacgacucgcccga

SEQ ID NO: 14692 - RNA, 51 nt, Artificial Sequence
  Description of Artificial Sequence: Synthetic oligonucleotide
gggaggacgaugcggacuuuuuguuauuuaucccgcagacgacucgcccga

SEQ ID NO: 14693 - RNA, 50 nt, Artificial Sequence
  Description of Artificial Sequence: Synthetic oligonucleotide
gggaggacgaugcgguuuaucuuuuuuuugugugcagacgacucgcccga

SEQ ID NO: 14694 - RNA, 51 nt, Artificial Sequence
  Description of Artificial Sequence: Synthetic oligonucleotide
gggaggacgaugcgggcuucuuucuuauuucaccgcagacgacucgcccga

SEQ ID NO: 14695 - RNA, 51 nt, Artificial Sequence
  Description of Artificial Sequence: Synthetic oligonucleotide
gggaggacgaugcggagauuauuuuuuuuguugugcagacgacucgcccga

SEQ ID NO: 14696 - RNA, 51 nt, Artificial Sequence
  Description of Artificial Sequence: Synthetic oligonucleotide
gggaggacgaugcggucucuguuaauuuauccccgcagacgacucgcccga

SEQ ID NO: 14697 - RNA, 50 nt, Artificial Sequence
  Description of Artificial Sequence: Synthetic oligonucleotide
gggaggacgaugcggcuuuauucacuuuuuuccgcagacgacucgcccga

SEQ ID NO: 14698 - RNA, 51 nt, Artificial Sequence
  Description of Artificial Sequence: Synthetic oligonucleotide
gggaggacgaugcgguuuuauuuuuuugucgggcccagacgacucgcccga

SEQ ID NO: 14699 - RNA, 51 nt, Artificial Sequence
  Description of Artificial Sequence: Synthetic oligonucleotide
gggaggacgaugcggucuauauugaucucucuccgcagacgacucgcccga

SEQ ID NO: 14700 - RNA, 52 nt, Artificial Sequence
  Description of Artificial Sequence: Synthetic oligonucleotide
gggaggacgaugcggguuugucuuuuuuuucguccgcagacgacucgcccga

SEQ ID NO: 14701 - RNA, 51 nt, Artificial Sequence
  Description of Artificial Sequence: Synthetic oligonucleotide
gggaggacgaugcggccuuuuacucuuuuucuccgcagacgacucgcccga

SEQ ID NO: 14702 - RNA, 52 nt, Artificial Sequence
  Description of Artificial Sequence: Synthetic oligonucleotide
gggaggacgaugcggcuuucacuuuuucucucuccgcagacgacucgcccga

SEQ ID NO: 14703 - RNA, 52 nt, Artificial Sequence
  Description of Artificial Sequence: Synthetic oligonucleotide
gggaggacgaugcggucuuuuuaacuuuuuucuccgcagacgacucgcccga

SEQ ID NO: 14704 - RNA, 51 nt, Artificial Sequence
  Description of Artificial Sequence: Synthetic oligonucleotide
gggaggacgaugcgguuuuugucuuuuuuuacccgcagacgacucgcccga

SEQ ID NO: 14705 - RNA, 52 nt, Artificial Sequence
  Description of Artificial Sequence: Synthetic oligonucleotide
gggaggacgaugcgggcuauucuuuucuuuuucccccagacgacucgcccga

SEQ ID NO: 14706 - RNA, 51 nt, Artificial Sequence
  Description of Artificial Sequence: Synthetic oligonucleotide
gggaggacgaugcgguuugaagguuuauggguccgcagacgacucgcccga

SEQ ID NO: 14707 - RNA, 52 nt, Artificial Sequence
  Description of Artificial Sequence: Synthetic oligonucleotide
gggaggacgaugcggccuuuacuuuaaucauucccgcagacgacucgcccga

SEQ ID NO: 14708 - RNA, 51 nt, Artificial Sequence
  Description of Artificial Sequence: Synthetic oligonucleotide
gggaggacgaugcggcuucauuuuaucucuuuccgcagacgacucgcccga

SEQ ID NO: 14709 - RNA, 51 nt, Artificial Sequence
  Description of Artificial Sequence: Synthetic oligonucleotide
gggaggacgaugcggcuuucacuuuuuuuucuccgcagacgacucgcccga

SEQ ID NO: 14710 - RNA, 51 nt, Artificial Sequence
  Description of Artificial Sequence: Synthetic oligonucleotide
gggaggacgaugcgguuuuucauuuccuuuuuccgcagacgacucgcccga

SEQ ID NO: 14711 - RNA, 53 nt, Artificial Sequence
  Description of Artificial Sequence: Synthetic oligonucleotide
gggaggacgaugcggccauuuguuuuuuuuuccuccgcagacgacucgcccga

SEQ ID NO: 14712 - RNA, 51 nt, Artificial Sequence
  Description of Artificial Sequence: Synthetic oligonucleotide
gggaggacgaugcggcuuguuuuucucuuuuuccgcagacgacucgcccga

SEQ ID NO: 14713 - RNA, 52 nt, Artificial Sequence
  Description of Artificial Sequence: Synthetic oligonucleotide
gggaggacgaugcggguucugucgucuguucguccccagacgacucgcccga

SEQ ID NO: 14714 - RNA, 49 nt, Artificial Sequence
  Description of Artificial Sequence: Synthetic oligonucleotide
gggaggacgaugcggauucuuguuuuuuugccgcagacgacucgcccga

SEQ ID NO: 14715 - RNA, 51 nt, Artificial Sequence
  Description of Artificial Sequence: Synthetic oligonucleotide
gggaggacgaugcgguccuuccguucugcccuccccagacgacucgcccga

SEQ ID NO: 14716 - RNA, 51 nt, Artificial Sequence
  Description of Artificial Sequence: Synthetic oligonucleotide
gggaggacgaugcggauucacuccuuuucuugccgcagacgacucgcccga

SEQ ID NO: 14717 - RNA, 51 nt, Artificial Sequence
  Description of Artificial Sequence: Synthetic oligonucleotide
gggaggacgaugcgguacucuuauuuuuaccuccgcagacgacucgcccga

SEQ ID NO: 14718 - RNA, 50 nt, Artificial Sequence
  Description of Artificial Sequence: Synthetic oligonucleotide
gggaggacgaugcgggcuuucguucuacccuccccagacgacucgcccga

SEQ ID NO: 14719 - RNA, 50 nt, Artificial Sequence
  Description of Artificial Sequence: Synthetic oligonucleotide
gggaggacgaugcgguucauuuucuuuucuuccgcagacgacucgcccga

SEQ ID NO: 14720 - RNA, 51 nt, Artificial Sequence
  Description of Artificial Sequence: Synthetic oligonucleotide
gggaggacgaugcgguccugucgacugcucguccccagacgacucgcccga

SEQ ID NO: 14721 - RNA, 52 nt, Artificial Sequence
  Description of Artificial Sequence: Synthetic oligonucleotide
gggaggacgaugcggguccugucgucucuucguccccagacgacucgcccga

SEQ ID NO: 14722 - RNA, 52 nt, Artificial Sequence
  Description of Artificial Sequence: Synthetic oligonucleotide
gggaggacgaugcggguccugucgucuguacguccccagacgacucgcccga

SEQ ID NO: 14723 - RNA, 49 nt, Artificial Sequence
  Description of Artificial Sequence: Synthetic oligonucleotide
gggaggacgaugcgggccuucguucucccuccccagacgacucgcccga

SEQ ID NO: 14724 - RNA, 51 nt, Artificial Sequence
  Description of Artificial Sequence: Synthetic oligonucleotide
gggaggacgaugcgguccuuauguuuuacgucccccagacgacucgcccga

SEQ ID NO: 14725 - RNA, 51 nt, Artificial Sequence
  Description of Artificial Sequence: Synthetic oligonucleotide
gggaggacgaugcgguacgcgguauaagugugccccagacgacucgcccga

SEQ ID NO: 14726 - RNA, 51 nt, Artificial Sequence
  Description of Artificial Sequence: Synthetic oligonucleotide
gggaggacgaugcgguuccuuuugcuuucucuccgcagacgacucgcccga

SEQ ID NO: 14727 - RNA, 50 nt, Artificial Sequence
  Description of Artificial Sequence: Synthetic oligonucleotide
gggaggacgaugcggugacucgucuguuuguccccagacgacucgcccga

SEQ ID NO: 14728 - RNA, 51 nt, Artificial Sequence
  Description of Artificial Sequence: Synthetic oligonucleotide
gggaggacgaugcggauucuugccuuuuuuugccgcagacgacucgcccga

SEQ ID NO: 14729 - RNA, 51 nt, Artificial Sequence
  Description of Artificial Sequence: Synthetic oligonucleotide
gggaggacgaugcgguuuuaaggguguuggguccgcagacgacucgcccga

SEQ ID NO: 14730 - RNA, 51 nt, Artificial Sequence
  Description of Artificial Sequence: Synthetic oligonucleotide
gggaggacgaugcggguuuuugucuuucucauccccagacgacucgcccga

SEQ ID NO: 14731 - RNA, 51 nt, Artificial Sequence
  Description of Artificial Sequence: Synthetic oligonucleotide
gggaggacgaugcgguucaucauucauuuucugcccagacgacucgcccga

SEQ ID NO: 14732 - RNA, 50 nt, Artificial Sequence
  Description of Artificial Sequence: Synthetic oligonucleotide
gggaggacgaugcgguccuuucguucugcccucccagacgacucgcccga

SEQ ID NO: 14733 - RNA, 51 nt, Artificial Sequence
  Description of Artificial Sequence: Synthetic oligonucleotide
gggaggacgaugcgguuuccugcuucuauuauccgcagacgacucgcccga

SEQ ID NO: 14734 - RNA, 52 nt, Artificial Sequence
  Description of Artificial Sequence: Synthetic oligonucleotide
gggaggacgaugcggauuuggucucuuuuuucgccgcagacgacucgcccga

SEQ ID NO: 14735 - RNA, 51 nt, Artificial Sequence
  Description of Artificial Sequence: Synthetic oligonucleotide
gggaggacgaugcgguguuuccuuuuccuucgccccagacgacucgcccga

SEQ ID NO: 14736 - RNA, 50 nt, Artificial Sequence
  Description of Artificial Sequence: Synthetic oligonucleotide
gggaggacgaugcggauuucucucuucuuugccgcagacgacucgcccga

SEQ ID NO: 14737 - RNA, 51 nt, Artificial Sequence
  Description of Artificial Sequence: Synthetic oligonucleotide
gggaggacgaugcggcauagggguagggugguagccagacgacucgcccga

SEQ ID NO: 14738 - RNA, 51 nt, Artificial Sequence
  Description of Artificial Sequence: Synthetic oligonucleotide
gggaggacgaugcgguccuugucgucuugcgaccccagacgacucgcccga

SEQ ID NO: 14739 - RNA, 51 nt, Artificial Sequence
  Description of Artificial Sequence: Synthetic oligonucleotide
gggaggacgaugcgggcuuuucguucugccccccccagacgacucgcccga

SEQ ID NO: 14740 - RNA, 51 nt, Artificial Sequence
  Description of Artificial Sequence: Synthetic oligonucleotide
gggaggacgaugcggucacagcggaauuguggccccagacgacucgcccga

SEQ ID NO: 14741 - RNA, 51 nt, Artificial Sequence
  Description of Artificial Sequence: Synthetic oligonucleotide
gggaggacgaugcggauuacucuuuucuuuugccgcagacgacucgcccga

SEQ ID NO: 14742 - RNA, 51 nt, Artificial Sequence
  Description of Artificial Sequence: Synthetic oligonucleotide
gggaggacgaugcggcucgcuuuucaucuucuccgcagacgacucgcccga

SEQ ID NO: 14743 - RNA, 50 nt, Artificial Sequence
  Description of Artificial Sequence: Synthetic oligonucleotide
gggaggacgaugcggucucaucuucuuuucuccgcagacgacucgcccga

SEQ ID NO: 14744 - RNA, 51 nt, Artificial Sequence
  Description of Artificial Sequence: Synthetic oligonucleotide
gggaggacgaugcggucuuuucaugcuucucuccgcagacgacucgcccga

SEQ ID NO: 14745 - RNA, 51 nt, Artificial Sequence
  Description of Artificial Sequence: Synthetic oligonucleotide
gggaggacgaugcgguccugucgccugcucguccccagacgacucgcccga

SEQ ID NO: 14746 - RNA, 51 nt, Artificial Sequence
  Description of Artificial Sequence: Synthetic oligonucleotide
gggaggacgaugcggauucuuuucucuuuucuccgcagacgacucgcccga

SEQ ID NO: 14747 - RNA, 51 nt, Artificial Sequence
  Description of Artificial Sequence: Synthetic oligonucleotide
gggaggacgaugcggacauuauuuucuucucugcccagacgacucgcccga

SEQ ID NO: 14748 - RNA, 51 nt, Artificial Sequence
  Description of Artificial Sequence: Synthetic oligonucleotide
gggaggacgaugcggccuauuccuuacucucuccgcagacgacucgcccga

SEQ ID NO: 14749 - RNA, 51 nt, Artificial Sequence
  Description of Artificial Sequence: Synthetic oligonucleotide
gggaggacgaugcggauacuuucacucucuucccgcagacgacucgcccga

SEQ ID NO: 14750 - RNA, 51 nt, Artificial Sequence
  Description of Artificial Sequence: Synthetic oligonucleotide
gggaggacgaugcgggccuuucguucuauccuccccagacgacucgcccga

SEQ ID NO: 14751 - RNA, 51 nt, Artificial Sequence
  Description of Artificial Sequence: Synthetic oligonucleotide
gggaggacgaugcggccuauuuucucuucuuugcccagacgacucgcccga

SEQ ID NO: 14752 - RNA, 53 nt, Artificial Sequence
  Description of Artificial Sequence: Synthetic oligonucleotide
gggaggacgaugcgguuuuagacucuuuuuuuugccccagacgacucgcccga

SEQ ID NO: 14753 - RNA, 51 nt, Artificial Sequence
  Description of Artificial Sequence: Synthetic oligonucleotide
gggaggacgaugcgguuuuccuauuuugccguccgcagacgacucgcccga

SEQ ID NO: 14754 - RNA, 51 nt, Artificial Sequence
  Description of Artificial Sequence: Synthetic oligonucleotide
gggaggacgaugcggucacuuuuucuuccacaccccagacgacucgcccga

SEQ ID NO: 14755 - RNA, 51 nt, Artificial Sequence
  Description of Artificial Sequence: Synthetic oligonucleotide
gggaggacgaugcggauuuucauuucuacccacugcagacgacucgcccga

SEQ ID NO: 14756 - RNA, 51 nt, Artificial Sequence
  Description of Artificial Sequence: Synthetic oligonucleotide
gggaggacgaugcggcuuuucuuccucuuuugccccagacgacucgcccga

SEQ ID NO: 14757 - RNA, 49 nt, Artificial Sequence
  Description of Artificial Sequence: Synthetic oligonucleotide
gggaggacgaugcgguuuuguuuuuuuucugcccagacgacucgcccga

SEQ ID NO: 14758 - RNA, 51 nt, Artificial Sequence
  Description of Artificial Sequence: Synthetic oligonucleotide
gggaggacgaugcggugucuuuuauuucuccgccccagacgacucgcccga

SEQ ID NO: 14759 - RNA, 51 nt, Artificial Sequence
  Description of Artificial Sequence: Synthetic oligonucleotide
gggaggacgaugcggcuauuuacuuuuuguccccgcagacgacucgcccga

SEQ ID NO: 14760 - RNA, 52 nt, Artificial Sequence
  Description of Artificial Sequence: Synthetic oligonucleotide
gggaggacgaugcggcuuuauuuuucaaccccuccgcagacgacucgcccga

SEQ ID NO: 14761 - RNA, 49 nt, Artificial Sequence
  Description of Artificial Sequence: Synthetic oligonucleotide
gggaggacgaugcggauuuuuguauucuugccccagacgacucgcccga

SEQ ID NO: 14762 - RNA, 50 nt, Artificial Sequence
  Description of Artificial Sequence: Synthetic oligonucleotide
gggaggacgaugcggucuuuauauuuccuuuccgcagacgacucgcccga

SEQ ID NO: 14763 - RNA, 51 nt, Artificial Sequence
  Description of Artificial Sequence: Synthetic oligonucleotide
gggaggacgaugcgguucuacuuauccuuuguccgcagacgacucgcccga

SEQ ID NO: 14764 - RNA, 51 nt, Artificial Sequence
  Description of Artificial Sequence: Synthetic oligonucleotide
gggaggacgaugcgguucucuuauuuacuucuccgcagacgacucgcccga

SEQ ID NO: 14765 - RNA, 51 nt, Artificial Sequence
  Description of Artificial Sequence: Synthetic oligonucleotide
gggaggacgaugcggcaucuuaauucuuuccucugcagacgacucgcccga

SEQ ID NO: 14766 - RNA, 51 nt, Artificial Sequence
  Description of Artificial Sequence: Synthetic oligonucleotide
gggaggacgaugcgguuuggagugugauggguccgcagacgacucgcccga

SEQ ID NO: 14767 - RNA, 51 nt, Artificial Sequence
  Description of Artificial Sequence: Synthetic oligonucleotide
gggaggacgaugcggaauuauguuuuuugugaccgcagacgacucgcccga

SEQ ID NO: 14768 - RNA, 50 nt, Artificial Sequence
  Description of Artificial Sequence: Synthetic oligonucleotide
gggaggacgaugcgguccuugucgucugcguccccagacgacucgcccga

SEQ ID NO: 14769 - RNA, 51 nt, Artificial Sequence
  Description of Artificial Sequence: Synthetic oligonucleotide
gggaggacgaugcgguuuggggcuuucccgugccgcagacgacucgcccga

SEQ ID NO: 14770 - RNA, 50 nt, Artificial Sequence
  Description of Artificial Sequence: Synthetic oligonucleotide
gggaggacgaugcgggucuucguucugcccuccccagacgacucgcccga

SEQ ID NO: 14771 - RNA, 51 nt, Artificial Sequence
  Description of Artificial Sequence: Synthetic oligonucleotide
gggaggacgaugcggaacacauuacacugugugcccagacgacucgcccga

SEQ ID NO: 14772 - RNA, 51 nt, Artificial Sequence
  Description of Artificial Sequence: Synthetic oligonucleotide
gggaggacgaugcgguuuuauucuuuuccucuccgcagacgacucgcccga

SEQ ID NO: 14773 - RNA, 51 nt, Artificial Sequence
  Description of Artificial Sequence: Synthetic oligonucleotide
gggaggacgaugcgguauucuaccuugcuucuccgcagacgacucgcccga

SEQ ID NO: 14774 - RNA, 51 nt, Artificial Sequence
  Description of Artificial Sequence: Synthetic oligonucleotide
gggaggacgaugcgguucauuucuucucuuuuccgcagacgacucgcccga

SEQ ID NO: 14775 - RNA, 53 nt, Artificial Sequence
  Description of Artificial Sequence: Synthetic oligonucleotide
gggaggacgaugcgguauuuuacguuuuuuuucgcugcagacgacucgcccga

SEQ ID NO: 14776 - RNA, 51 nt, Artificial Sequence
  Description of Artificial Sequence: Synthetic oligonucleotide
gggaggacgaugcggcucacuuuuucuuuaccccccagacgacucgcccga

SEQ ID NO: 14777 - RNA, 51 nt, Artificial Sequence
  Description of Artificial Sequence: Synthetic oligonucleotide
gggaggacgaugcgguuugaaggguguugguuccgcagacgacucgcccga

SEQ ID NO: 14778 - RNA, 51 nt, Artificial Sequence
  Description of Artificial Sequence: Synthetic oligonucleotide
gggaggacgaugcgguucgaagggugacggguccgcagacgacucgcccga

SEQ ID NO: 14779 - RNA, 51 nt, Artificial Sequence
  Description of Artificial Sequence: Synthetic oligonucleotide
gggaggacgaugcgguuagggaguaggguguuccgcagacgacucgcccga

SEQ ID NO: 14780 - RNA, 51 nt, Artificial Sequence
  Description of Artificial Sequence: Synthetic oligonucleotide
gggaggacgaugcgguuuuuguuuuauugguuccgcagacgacucgcccga

SEQ ID NO: 14781 - RNA, 51 nt, Artificial Sequence
  Description of Artificial Sequence: Synthetic oligonucleotide
gggaggacgaugcgggccuuucguucuacccuccgcagacgacucgcccga

SEQ ID NO: 14782 - RNA, 51 nt, Artificial Sequence
  Description of Artificial Sequence: Synthetic oligonucleotide
gggaggacgaugcggauucuuuucucuuuccaccgcagacgacucgcccga

SEQ ID NO: 14783 - RNA, 51 nt, Artificial Sequence
  Description of Artificial Sequence: Synthetic oligonucleotide
gggaggacgaugcgguuugaaggguguuagguccgcagacgacucgcccga

SEQ ID NO: 14784 - RNA, 51 nt, Artificial Sequence
  Description of Artificial Sequence: Synthetic oligonucleotide
gggaggacgaugcgguugggugcagggcgguaccgcagacgacucgcccga

SEQ ID NO: 14785 - RNA, 51 nt, Artificial Sequence
  Description of Artificial Sequence: Synthetic oligonucleotide
gggaggacgaugcgguuugaggggagguggguccgcagacgacucgcccga

SEQ ID NO: 14786 - RNA, 51 nt, Artificial Sequence
  Description of Artificial Sequence: Synthetic oligonucleotide
gggaggacgaugcgggauauuuacuuuuuuuggcccagacgacucgcccga

SEQ ID NO: 14787 - RNA, 51 nt, Artificial Sequence
  Description of Artificial Sequence: Synthetic oligonucleotide
gggaggacgaugcgguuugacggguguuggguccgcagacgacucgcccga

SEQ ID NO: 14788 - RNA, 51 nt, Artificial Sequence
  Description of Artificial Sequence: Synthetic oligonucleotide
gggaggacgaugcggucuguuuuucucuuuuuccgcagacgacucgcccga

SEQ ID NO: 14789 - RNA, 52 nt, Artificial Sequence
  Description of Artificial Sequence: Synthetic oligonucleotide
gggaggacgaugcggacauuucauuuuuuucccccgcagacgacucgcccga

SEQ ID NO: 14790 - RNA, 50 nt, Artificial Sequence
  Description of Artificial Sequence: Synthetic oligonucleotide
gggaggacgaugcgguucuuauuuuuucccuccgcagacgacucgcccga

SEQ ID NO: 14791 - RNA, 50 nt, Artificial Sequence
  Description of Artificial Sequence: Synthetic oligonucleotide
gggaggacgaugcggccuuuuuauguucuuuccgcagacgacucgcccga

SEQ ID NO: 14792 - RNA, 51 nt, Artificial Sequence
  Description of Artificial Sequence: Synthetic oligonucleotide
gggaggacgaugcggcuucuuguguuuuuuugcugcagacgacucgcccga

SEQ ID NO: 14793 - RNA, 50 nt, Artificial Sequence
  Description of Artificial Sequence: Synthetic oligonucleotide
gggaggacgaugcgguucuucuucuuuuccuccgcagacgacucgcccga

SEQ ID NO: 14794 - RNA, 51 nt, Artificial Sequence
  Description of Artificial Sequence: Synthetic oligonucleotide
gggaggacgaugcgguuugaaguguuauggguccgcagacgacucgcccga

SEQ ID NO: 14795 - RNA, 51 nt, Artificial Sequence
  Description of Artificial Sequence: Synthetic oligonucleotide
gggaggacgaugcggguucuuaaucaccuuuuccccagacgacucgcccga

SEQ ID NO: 14796 - RNA, 51 nt, Artificial Sequence
  Description of Artificial Sequence: Synthetic oligonucleotide
gggaggacgaugcgguguauuauuauuuguugcugcagacgacucgcccga

SEQ ID NO: 14797 - RNA, 51 nt, Artificial Sequence
  Description of Artificial Sequence: Synthetic oligonucleotide
gggaggacgaugcggcuuuauuuuuguuuuuugcccagacgacucgcccga

SEQ ID NO: 14798 - RNA, 51 nt, Artificial Sequence
  Description of Artificial Sequence: Synthetic oligonucleotide
gggaggacgaugcggccauauuucuucuuuauccccagacgacucgcccga

SEQ ID NO: 14799 - RNA, 50 nt, Artificial Sequence
  Description of Artificial Sequence: Synthetic oligonucleotide
gggaggacgaugcgguuuuuucuccgguuuuccgcagacgacucgcccga

SEQ ID NO: 14800 - RNA, 51 nt, Artificial Sequence
  Description of Artificial Sequence: Synthetic oligonucleotide
gggaggacgaugcgguauucuucauuauuugucaccagacgacucgcccga

SEQ ID NO: 14801 - RNA, 51 nt, Artificial Sequence
  Description of Artificial Sequence: Synthetic oligonucleotide
gggaggacgaugcggccuuuuuuuguccuuugccccagacgacucgcccga

SEQ ID NO: 14802 - RNA, 51 nt, Artificial Sequence
  Description of Artificial Sequence: Synthetic oligonucleotide
gggaggacgaugcggcucauuuauuacuuuuaccgcagacgacucgcccga

SEQ ID NO: 14803 - RNA, 51 nt, Artificial Sequence
  Description of Artificial Sequence: Synthetic oligonucleotide
gggaggacgaugcggauuuuaucuauccguuuccgcagacgacucgcccga

SEQ ID NO: 14804 - RNA, 51 nt, Artificial Sequence
  Description of Artificial Sequence: Synthetic oligonucleotide
gggaggacgaugcggcuuucacgucaucuuuuccgcagacgacucgcccga

SEQ ID NO: 14805 - RNA, 51 nt, Artificial Sequence
  Description of Artificial Sequence: Synthetic oligonucleotide
gggaggacgaugcgggcuuuacguucuuuauuccgcagacgacucgcccga

SEQ ID NO: 14806 - RNA, 51 nt, Artificial Sequence
  Description of Artificial Sequence: Synthetic oligonucleotide
gggaggacgaugcggucacauuuacuuuuuuugcgcagacgacucgcccga

SEQ ID NO: 14807 - RNA, 51 nt, Artificial Sequence
  Description of Artificial Sequence: Synthetic oligonucleotide
gggaggacgaugcggcuuguuguuuuuuuuauccccagacgacucgcccga

SEQ ID NO: 14808 - RNA, 51 nt, Artificial Sequence
  Description of Artificial Sequence: Synthetic oligonucleotide
gggaggacgaugcgguuccuuuuuacuuucuugugcagacgacucgcccga

SEQ ID NO: 14809 - RNA, 51 nt, Artificial Sequence
  Description of Artificial Sequence: Synthetic oligonucleotide
gggaggacgaugcgguuuucucuucucuacuucugcagacgacucgcccga

SEQ ID NO: 14810 - RNA, 51 nt, Artificial Sequence
  Description of Artificial Sequence: Synthetic oligonucleotide
gggaggacgaugcggcuucacuuauuccuuauccccagacgacucgcccga

SEQ ID NO: 14811 - RNA, 51 nt, Artificial Sequence
  Description of Artificial Sequence: Synthetic oligonucleotide
gggaggacgaugcggauuuuuacauuugcucuccgcagacgacucgcccga

SEQ ID NO: 14812 - RNA, 51 nt, Artificial Sequence
  Description of Artificial Sequence: Synthetic oligonucleotide
gggaggacgaugcgguuaucuauauucucucugugcagacgacucgcccga

SEQ ID NO: 14813 - RNA, 51 nt, Artificial Sequence
  Description of Artificial Sequence: Synthetic oligonucleotide
gggaggacgaugcggucuuuucauuuuucucuccgcagacgacucgcccga

SEQ ID NO: 14814 - RNA, 52 nt, Artificial Sequence
  Description of Artificial Sequence: Synthetic oligonucleotide
gggaggacgaugcgguuuuuuuacuucucuucgcugcagacgacucgcccga

SEQ ID NO: 14815 - RNA, 52 nt, Artificial Sequence
  Description of Artificial Sequence: Synthetic oligonucleotide
gggaggacgaugcggcuuuuacuguuuccuuuuccgcagacgacucgcccga

SEQ ID NO: 14816 - RNA, 51 nt, Artificial Sequence
  Description of Artificial Sequence: Synthetic oligonucleotide
gggaggacgaugcggauuuguucuuuaauuugccgcagacgacucgcccga

SEQ ID NO: 14817 - RNA, 51 nt, Artificial Sequence
  Description of Artificial Sequence: Synthetic oligonucleotide
gggaggacgaugcgguucuuuauuuucucccuccgcagacgacucgcccga

SEQ ID NO: 14818 - RNA, 51 nt, Artificial Sequence
  Description of Artificial Sequence: Synthetic oligonucleotide
gggaggacgaugcggcuuuccaggcuuuuucuccgcagacgacucgcccga

SEQ ID NO: 14819 - RNA, 51 nt, Artificial Sequence
  Description of Artificial Sequence: Synthetic oligonucleotide
gggaggacgaugcggucaguuauuauuuuuuucgccagacgacucgcccga

SEQ ID NO: 14820 - RNA, 51 nt, Artificial Sequence
  Description of Artificial Sequence: Synthetic oligonucleotide
gggaggacgaugcgguaugaaggugaggugguccgcagacgacucgcccga

SEQ ID NO: 14821 - RNA, 51 nt, Artificial Sequence
  Description of Artificial Sequence: Synthetic oligonucleotide
gggaggacgaugcggcuuaaucuuucuuccuuccgcagacgacucgcccga

SEQ ID NO: 14822 - RNA, 51 nt, Artificial Sequence
  Description of Artificial Sequence: Synthetic oligonucleotide
gggaggacgaugcggacucuuaucuuaucuugccgcagacgacucgcccga

SEQ ID NO: 14823 - RNA, 51 nt, Artificial Sequence
  Description of Artificial Sequence: Synthetic oligonucleotide
gggaggacgaugcgguuuucuuuuucacuuuuccgcagacgacucgcccga

SEQ ID NO: 14824 - RNA, 51 nt, Artificial Sequence
  Description of Artificial Sequence: Synthetic oligonucleotide
gggaggacgaugcggucauuaucuuucuucuccaccagacgacucgcccga

SEQ ID NO: 14825 - RNA, 51 nt, Artificial Sequence
  Description of Artificial Sequence: Synthetic oligonucleotide
gggaggacgaugcggaauuauuuuuugccucuccgcagacgacucgcccga

SEQ ID NO: 14826 - RNA, 51 nt, Artificial Sequence
  Description of Artificial Sequence: Synthetic oligonucleotide
gggaggacgaugcggcucuuuuugguuacucuccgcagacgacucgcccga

SEQ ID NO: 14827 - RNA, 51 nt, Artificial Sequence
  Description of Artificial Sequence: Synthetic oligonucleotide
gggaggacgaugcgguuuacucuuaccuuugcccgcagacgacucgcccga

SEQ ID NO: 14828 - RNA, 51 nt, Artificial Sequence
  Description of Artificial Sequence: Synthetic oligonucleotide
gggaggacgaugcggguccuuuuacuuuuuccccgcagacgacucgcccga

SEQ ID NO: 14829 - RNA, 50 nt, Artificial Sequence
  Description of Artificial Sequence: Synthetic oligonucleotide
gggaggacgaugcgggcuucuuuucucuuuuccccagacgacucgcccga

SEQ ID NO: 14830 - RNA, 51 nt, Artificial Sequence
  Description of Artificial Sequence: Synthetic oligonucleotide
gggaggacgaugcggguaucuuuuuccucgcuccgcagacgacucgcccga

SEQ ID NO: 14831 - RNA, 52 nt, Artificial Sequence
  Description of Artificial Sequence: Synthetic oligonucleotide
gggaggacgaugcggaccuauucuuuuacccuaccgcagacgacucgcccga

SEQ ID NO: 14832 - RNA, 52 nt, Artificial Sequence
  Description of Artificial Sequence: Synthetic oligonucleotide
gggaggacgaugcgguauuuauuuuuuuucucucugcagacgacucgcccga

SEQ ID NO: 14833 - RNA, 51 nt, Artificial Sequence
  Description of Artificial Sequence: Synthetic oligonucleotide
gggaggacgaugcggucccuuuguucuuuucaccgcagacgacucgcccga

SEQ ID NO: 14834 - RNA, 51 nt, Artificial Sequence
  Description of Artificial Sequence: Synthetic oligonucleotide
gggaggacgaugcgguguuuuauuuuaucuguucccagacgacucgcccga

SEQ ID NO: 14835 - RNA, 51 nt, Artificial Sequence
  Description of Artificial Sequence: Synthetic oligonucleotide
gggaggacgaugcggcuuuuucacuucuauuuccccagacgacucgcccga

SEQ ID NO: 14836 - RNA, 51 nt, Artificial Sequence
  Description of Artificial Sequence: Synthetic oligonucleotide
gggaggacgaugcggcacuuuugcucuuuucucgccagacgacucgcccga

SEQ ID NO: 14837 - RNA, 51 nt, Artificial Sequence
  Description of Artificial Sequence: Synthetic oligonucleotide
gggaggacgaugcggccacuuuuaauuuucuccgccagacgacucgcccga

SEQ ID NO: 14838 - RNA, 51 nt, Artificial Sequence
  Description of Artificial Sequence: Synthetic oligonucleotide
gggaggacgaugcgguuucacuaucuuaccuuccgcagacgacucgcccga

SEQ ID NO: 14839 - RNA, 51 nt, Artificial Sequence
  Description of Artificial Sequence: Synthetic oligonucleotide
gggaggacgaugcgguuugaaugguguuggguccgcagacgacucgcccga

SEQ ID NO: 14840 - RNA, 52 nt, Artificial Sequence
  Description of Artificial Sequence: Synthetic oligonucleotide
gggaggacgaugcgguuucuacuuuuucauuguccgcagacgacucgcccga

SEQ ID NO: 14841 - RNA, 51 nt, Artificial Sequence
  Description of Artificial Sequence: Synthetic oligonucleotide
gggaggacgaugcgguuugaugguugauggguccgcagacgacucgcccga

SEQ ID NO: 14842 - RNA, 51 nt, Artificial Sequence
  Description of Artificial Sequence: Synthetic oligonucleotide
gggaggacgaugcgguuuaucacuuuucuuugcaccagacgacucgcccga

SEQ ID NO: 14843 - RNA, 51 nt, Artificial Sequence
  Description of Artificial Sequence: Synthetic oligonucleotide
gggaggacgaugcggacuuugucauccuuuugccgcagacgacucgcccga

SEQ ID NO: 14844 - RNA, 51 nt, Artificial Sequence
  Description of Artificial Sequence: Synthetic oligonucleotide
gggaggacgaugcggccuucacuuuuucuuuuccgcagacgacucgcccga

SEQ ID NO: 14845 - RNA, 51 nt, Artificial Sequence
  Description of Artificial Sequence: Synthetic oligonucleotide
gggaggacgaugcggcuuucauucacauuccuccgcagacgacucgcccga

SEQ ID NO: 14846 - RNA, 51 nt, Artificial Sequence
  Description of Artificial Sequence: Synthetic oligonucleotide
gggaggacgaugcggcuuuuucagucuugcuuccgcagacgacucgcccga

SEQ ID NO: 14847 - RNA, 51 nt, Artificial Sequence
  Description of Artificial Sequence: Synthetic oligonucleotide
gggaggacgaugcgggauuuguuuauguuuaccugcagacgacucgcccga

SEQ ID NO: 14848 - RNA, 51 nt, Artificial Sequence
  Description of Artificial Sequence: Synthetic oligonucleotide
gggaggacgaugcgguuuccguucuauuuucugcccagacgacucgcccga

SEQ ID NO: 14849 - RNA, 51 nt, Artificial Sequence
  Description of Artificial Sequence: Synthetic oligonucleotide
gggaggacgaugcggcuuuuuuuuccuuuuuuccgcagacgacucgcccga

SEQ ID NO: 14850 - RNA, 51 nt, Artificial Sequence
  Description of Artificial Sequence: Synthetic oligonucleotide
gggaggacgaugcgguuauuuauuucuuuugugugcagacgacucgcccga

SEQ ID NO: 14851 - RNA, 51 nt, Artificial Sequence
  Description of Artificial Sequence: Synthetic oligonucleotide
gggaggacgaugcggcauucguuuacuuuuucccgcagacgacucgcccga

SEQ ID NO: 14852 - RNA, 51 nt, Artificial Sequence
  Description of Artificial Sequence: Synthetic oligonucleotide
gggaggacgaugcggaaaggaggagcugggaucugcagacgacucgcccga

SEQ ID NO: 14853 - RNA, 51 nt, Artificial Sequence
  Description of Artificial Sequence: Synthetic oligonucleotide
gggaggacgaugcggguugggguagggggguuccgcagacgacucgcccga

SEQ ID NO: 14854 - RNA, 51 nt, Artificial Sequence
  Description of Artificial Sequence: Synthetic oligonucleotide
gggaggacgaugcggcuuuucacggcuuuuuuccgcagacgacucgcccga

SEQ ID NO: 14855 - RNA, 53 nt, Artificial Sequence
  Description of Artificial Sequence: Synthetic oligonucleotide
gggaggacgaugcgguacuuuucuuuuuuuuucuccgcagacgacucgcccga

SEQ ID NO: 14856 - RNA, 51 nt, Artificial Sequence
  Description of Artificial Sequence: Synthetic oligonucleotide
gggaggacgaugcggucacauucauuuuaucucuccagacgacucgcccga

SEQ ID NO: 14857 - RNA, 51 nt, Artificial Sequence
  Description of Artificial Sequence: Synthetic oligonucleotide
gggaggacgaugcgggucuuaaaacuuucucuccgcagacgacucgcccga

SEQ ID NO: 14858 - RNA, 51 nt, Artificial Sequence
  Description of Artificial Sequence: Synthetic oligonucleotide
gggaggacgaugcgguuuccauuuucccucauccgcagacgacucgcccga

SEQ ID NO: 14859 - RNA, 51 nt, Artificial Sequence
  Description of Artificial Sequence: Synthetic oligonucleotide
gggaggacgaugcgguuucucauucaauuuugccccagacgacucgcccga

SEQ ID NO: 14860 - RNA, 51 nt, Artificial Sequence
  Description of Artificial Sequence: Synthetic oligonucleotide
gggaggacgaugcgggucacauuauuuuacuuccccagacgacucgcccga

SEQ ID NO: 14861 - RNA, 50 nt, Artificial Sequence
  Description of Artificial Sequence: Synthetic oligonucleotide
gggaggacgaugcgggcccucguucugcccuccccagacgacucgcccga

SEQ ID NO: 14862 - RNA, 49 nt, Artificial Sequence
  Description of Artificial Sequence: Synthetic oligonucleotide
gggaggacgaugcggccuucguucugcccuccccagacgacucgcccga

SEQ ID NO: 14863 - RNA, 49 nt, Artificial Sequence
  Description of Artificial Sequence: Synthetic oligonucleotide
gggaggacgaugcgggccuuucguucucccucccagacgacucgcccga

SEQ ID NO: 14864 - RNA, 51 nt, Artificial Sequence
  Description of Artificial Sequence: Synthetic oligonucleotide
gggaggacgaugcgggccuuucguucugcuucccccagacgacucgcccga

SEQ ID NO: 14865 - RNA, 52 nt, Artificial Sequence
  Description of Artificial Sequence: Synthetic oligonucleotide
gggaggacgaugcgggccauuucguucugcccuccccagacgacucgcccga

SEQ ID NO: 14866 - RNA, 51 nt, Artificial Sequence
  Description of Artificial Sequence: Synthetic oligonucleotide
gggaggacgaugcgguccuuucggucugcccuccccagacgacucgcccga

SEQ ID NO: 14867 - RNA, 50 nt, Artificial Sequence
  Description of Artificial Sequence: Synthetic oligonucleotide
gggaggacgaugcgggccuucguucugccucccccagacgacucgcccga

SEQ ID NO: 14868 - RNA, 51 nt, Artificial Sequence
  Description of Artificial Sequence: Synthetic oligonucleotide
gggaggacgaugcggacuaucucuuuauuccaccgcagacgacucgcccga

SEQ ID NO: 14869 - RNA, 51 nt, Artificial Sequence
  Description of Artificial Sequence: Synthetic oligonucleotide
gggaggacgaugcgguaucuuauucuucgcuuugccagacgacucgcccga

SEQ ID NO: 14870 - RNA, 51 nt, Artificial Sequence
  Description of Artificial Sequence: Synthetic oligonucleotide
gggaggacgaugcggccguuuuuccuuuuuauccgcagacgacucgcccga

SEQ ID NO: 14871 - RNA, 51 nt, Artificial Sequence
  Description of Artificial Sequence: Synthetic oligonucleotide
gggaggacgaugcggcauuucuuauuacucuucgccagacgacucgcccga

SEQ ID NO: 14872 - RNA, 51 nt, Artificial Sequence
  Description of Artificial Sequence: Synthetic oligonucleotide
gggaggacgaugcggauuuuccuuuuuuuucccgccagacgacucgcccga

SEQ ID NO: 14873 - RNA, 51 nt, Artificial Sequence
  Description of Artificial Sequence: Synthetic oligonucleotide
gggaggacgaugcggccuuuuaacauguuucuccgcagacgacucgcccga

SEQ ID NO: 14874 - RNA, 52 nt, Artificial Sequence
  Description of Artificial Sequence: Synthetic oligonucleotide
gggaggacgaugcgguuuuuuucuuugcccuuuccgcagacgacucgcccga

SEQ ID NO: 14875 - RNA, 52 nt, Artificial Sequence
  Description of Artificial Sequence: Synthetic oligonucleotide
gggaggacgaugcgguuuuuuucuaauuucuccccgcagacgacucgcccga

SEQ ID NO: 14876 - RNA, 51 nt, Artificial Sequence
  Description of Artificial Sequence: Synthetic oligonucleotide
gggaggacgaugcgggucauucauuuuucucgccgcagacgacucgcccga

SEQ ID NO: 14877 - RNA, 51 nt, Artificial Sequence
  Description of Artificial Sequence: Synthetic oligonucleotide
gggaggacgaugcggucacuauucuuuucuuucugcagacgacucgcccga

SEQ ID NO: 14878 - RNA, 49 nt, Artificial Sequence
  Description of Artificial Sequence: Synthetic oligonucleotide
gggaggacgaugcggauuucucuucuuuugccgcagacgacucgcccga

SEQ ID NO: 14879 - RNA, 51 nt, Artificial Sequence
  Description of Artificial Sequence: Synthetic oligonucleotide
gggaggacgaugcggucacuucuuaauuuauuccccagacgacucgcccga

SEQ ID NO: 14880 - RNA, 52 nt, Artificial Sequence
  Description of Artificial Sequence: Synthetic oligonucleotide
gggaggacgaugcggaucuuucgcuuuuuuuucccgcagacgacucgcccga

SEQ ID NO: 14881 - RNA, 51 nt, Artificial Sequence
  Description of Artificial Sequence: Synthetic oligonucleotide
gggaggacgaugcggucuuuuacuuuuuuucuccgcagacgacucgcccga

SEQ ID NO: 14882 - RNA, 52 nt, Artificial Sequence
  Description of Artificial Sequence: Synthetic oligonucleotide
gggaggacgaugcgguuuuauucacuuuuuuguccccagacgacucgcccga

SEQ ID NO: 14883 - RNA, 51 nt, Artificial Sequence
  Description of Artificial Sequence: Synthetic oligonucleotide
gggaggacgaugcggguuuuacuuugcuccugccgcagacgacucgcccga

SEQ ID NO: 14884 - RNA, 51 nt, Artificial Sequence
  Description of Artificial Sequence: Synthetic oligonucleotide
gggaggacgaugcggccuuuauucacuuuuuuccgcagacgacucgcccga

SEQ ID NO: 14885 - RNA, 51 nt, Artificial Sequence
  Description of Artificial Sequence: Synthetic oligonucleotide
gggaggacgaugcggauuuucucuucuuucugccgcagacgacucgcccga

SEQ ID NO: 14886 - RNA, 51 nt, Artificial Sequence
  Description of Artificial Sequence: Synthetic oligonucleotide
gggaggacgaugcgguuuguuuuauuuuugucccccagacgacucgcccga

SEQ ID NO: 14887 - RNA, 51 nt, Artificial Sequence
  Description of Artificial Sequence: Synthetic oligonucleotide
gggaggacgaugcggcuacauuuucuucuccuccgcagacgacucgcccga

SEQ ID NO: 14888 - RNA, 51 nt, Artificial Sequence
  Description of Artificial Sequence: Synthetic oligonucleotide
gggaggacgaugcggcacaggaguagggugguagccagacgacucgcccga

SEQ ID NO: 14889 - RNA, 51 nt, Artificial Sequence
  Description of Artificial Sequence: Synthetic oligonucleotide
gggaggacgaugcggcuuuaucucaucucgcuccgcagacgacucgcccga

SEQ ID NO: 14890 - RNA, 51 nt, Artificial Sequence
  Description of Artificial Sequence: Synthetic oligonucleotide
gggaggacgaugcgguuguuuuccugauuguuccgcagacgacucgcccga

SEQ ID NO: 14891 - RNA, 51 nt, Artificial Sequence
  Description of Artificial Sequence: Synthetic oligonucleotide
gggaggacgaugcggcuuuuucuuuaucuuugccccagacgacucgcccga

SEQ ID NO: 14892 - RNA, 51 nt, Artificial Sequence
  Description of Artificial Sequence: Synthetic oligonucleotide
gggaggacgaugcgguuugaagggagaugggugcgcagacgacucgcccga

SEQ ID NO: 14893 - RNA, 51 nt, Artificial Sequence
  Description of Artificial Sequence: Synthetic oligonucleotide
gggaggacgaugcgguuugaaggguggugaguccgcagacgacucgcccga

SEQ ID NO: 14894 - RNA, 52 nt, Artificial Sequence
  Description of Artificial Sequence: Synthetic oligonucleotide
gggaggacgaugcggguuuuuuugaucucuuguccccagacgacucgcccga

SEQ ID NO: 14895 - RNA, 53 nt, Artificial Sequence
  Description of Artificial Sequence: Synthetic oligonucleotide
gggaggacgaugcggauuugcuuuuuuuuugguuccgcagacgacucgcccga

SEQ ID NO: 14896 - RNA, 52 nt, Artificial Sequence
  Description of Artificial Sequence: Synthetic oligonucleotide
gggaggacgaugcggcaucuucaugcuuuuuuuccgcagacgacucgcccga

SEQ ID NO: 14897 - RNA, 53 nt, Artificial Sequence
  Description of Artificial Sequence: Synthetic oligonucleotide
gggaggacgaugcggacuuuuuuuucucuccuuuccgcagacgacucgcccga

SEQ ID NO: 14898 - RNA, 52 nt, Artificial Sequence
  Description of Artificial Sequence: Synthetic oligonucleotide
gggaggacgaugcgggccuuucguucugcccucccgcagacgacucgcccga

SEQ ID NO: 14899 - RNA, 51 nt, Artificial Sequence
  Description of Artificial Sequence: Synthetic oligonucleotide
gggaggacgaugcggaucucuucuuucuucugccgcagacgacucgcccga

SEQ ID NO: 14900 - RNA, 51 nt, Artificial Sequence
  Description of Artificial Sequence: Synthetic oligonucleotide
gggaggacgaugcgguuuggggggagggggguccgcagacgacucgcccga

SEQ ID NO: 14901 - RNA, 51 nt, Artificial Sequence
  Description of Artificial Sequence: Synthetic oligonucleotide
gggaggacgaugcgguuugaagguugauggggccgcagacgacucgcccga

SEQ ID NO: 14902 - RNA, 51 nt, Artificial Sequence
  Description of Artificial Sequence: Synthetic oligonucleotide
gggaggacgaugcgguuugaacggggauggguccgcagacgacucgcccga

SEQ ID NO: 14903 - RNA, 51 nt, Artificial Sequence
  Description of Artificial Sequence: Synthetic oligonucleotide
gggaggacgaugcgguuugcagggugauggggccgcagacgacucgcccga

SEQ ID NO: 14904 - RNA, 51 nt, Artificial Sequence
  Description of Artificial Sequence: Synthetic oligonucleotide
gggaggacgaugcgguuuggagguugauggguccgcagacgacucgcccga

SEQ ID NO: 14905 - RNA, 51 nt, Artificial Sequence
  Description of Artificial Sequence: Synthetic oligonucleotide
gggaggacgaugcgguuuucuuagcccuuuguccgcagacgacucgcccga

SEQ ID NO: 14906 - RNA, 51 nt, Artificial Sequence
  Description of Artificial Sequence: Synthetic oligonucleotide
gggaggacgaugcggacacuuucuuacuuucucaccagacgacucgcccga

SEQ ID NO: 14907 - RNA, 51 nt, Artificial Sequence
  Description of Artificial Sequence: Synthetic oligonucleotide
gggaggacgaugcggcuuaggaguagggugguagccagacgacucgcccga

SEQ ID NO: 14908 - RNA, 52 nt, Artificial Sequence
  Description of Artificial Sequence: Synthetic oligonucleotide
gggaggacgaugcgguauuuuacuaaccuuuuuccgcagacgacucgcccga

SEQ ID NO: 14909 - RNA, 50 nt, Artificial Sequence
  Description of Artificial Sequence: Synthetic oligonucleotide
gggaggacgaugcgguuucuuucguuuuucuccgcagacgacucgcccga

SEQ ID NO: 14910 - RNA, 52 nt, Artificial Sequence
  Description of Artificial Sequence: Synthetic oligonucleotide
gggaggacgaugcgguuauuuaaauuuuuuguugugcagacgacucgcccga

SEQ ID NO: 14911 - RNA, 51 nt, Artificial Sequence
  Description of Artificial Sequence: Synthetic oligonucleotide
gggaggacgaugcgguauccuuuuucuuuuuugcccagacgacucgcccga

SEQ ID NO: 14912 - RNA, 51 nt, Artificial Sequence
  Description of Artificial Sequence: Synthetic oligonucleotide
gggaggacgaugcggaccuuuaacguuucauuccgcagacgacucgcccga

SEQ ID NO: 14913 - RNA, 52 nt, Artificial Sequence
  Description of Artificial Sequence: Synthetic oligonucleotide
gggaggacgaugcgguucuuuguuuuuuuucucccgcagacgacucgcccga

SEQ ID NO: 14914 - RNA, 50 nt, Artificial Sequence
  Description of Artificial Sequence: Synthetic oligonucleotide
gggaggacgaugcgguuuguuuauuuuuuuuccgcagacgacucgcccga

SEQ ID NO: 14915 - RNA, 53 nt, Artificial Sequence
  Description of Artificial Sequence: Synthetic oligonucleotide
gggaggacgaugcgguaccuauucucguuuuuuugcccagacgacucgcccga

SEQ ID NO: 14916 - RNA, 51 nt, Artificial Sequence
  Description of Artificial Sequence: Synthetic oligonucleotide
gggaggacgaugcgguuuuuauguuuucucgucgccagacgacucgcccga

SEQ ID NO: 14917 - RNA, 51 nt, Artificial Sequence
  Description of Artificial Sequence: Synthetic oligonucleotide
gggaggacgaugcgguuuuguuuuuuuuuucugcccagacgacucgcccga

SEQ ID NO: 14918 - RNA, 50 nt, Artificial Sequence
  Description of Artificial Sequence: Synthetic oligonucleotide
gggaggacgaugcggucuuauuuuucucucuccgcagacgacucgcccga

SEQ ID NO: 14919 - RNA, 51 nt, Artificial Sequence
  Description of Artificial Sequence: Synthetic oligonucleotide
gggaggacgaugcgguuugaagggccauggguccgcagacgacucgcccga

SEQ ID NO: 14920 - RNA, 50 nt, Artificial Sequence
  Description of Artificial Sequence: Synthetic oligonucleotide
gggaggacgaugcggccuuuacuuuuuuucuccgcagacgacucgcccga

SEQ ID NO: 14921 - RNA, 51 nt, Artificial Sequence
  Description of Artificial Sequence: Synthetic oligonucleotide
gggaggacgaugcggccauuuaauuuuuucucccgcagacgacucgcccga

SEQ ID NO: 14922 - RNA, 52 nt, Artificial Sequence
  Description of Artificial Sequence: Synthetic oligonucleotide
gggaggacgaugcgguauuuucucuuuacuuuuccccagacgacucgcccga

SEQ ID NO: 14923 - RNA, 51 nt, Artificial Sequence
  Description of Artificial Sequence: Synthetic oligonucleotide
gggaggacgaugcgguuuuauuuucucuucauuggcagacgacucgcccga

SEQ ID NO: 14924 - RNA, 50 nt, Artificial Sequence
  Description of Artificial Sequence: Synthetic oligonucleotide
gggaggacgaugcgguucuuucuucuuuucuccgcagacgacucgcccga

SEQ ID NO: 14925 - RNA, 51 nt, Artificial Sequence
  Description of Artificial Sequence: Synthetic oligonucleotide
gggaggacgaugcgguuugaaggguaaugggcccgcagacgacucgcccga

SEQ ID NO: 14926 - RNA, 51 nt, Artificial Sequence
  Description of Artificial Sequence: Synthetic oligonucleotide
gggaggacgaugcgguuagaagggcgauggguccgcagacgacucgcccga

SEQ ID NO: 14927 - RNA, 51 nt, Artificial Sequence
  Description of Artificial Sequence: Synthetic oligonucleotide
gggaggacgaugcgguuugcggggugauggguccgcagacgacucgcccga

SEQ ID NO: 14928 - RNA, 51 nt, Artificial Sequence
  Description of Artificial Sequence: Synthetic oligonucleotide
gggaggacgaugcggucuauuccucccugccgccccagacgacucgcccga

SEQ ID NO: 14929 - RNA, 52 nt, Artificial Sequence
  Description of Artificial Sequence: Synthetic oligonucleotide
gggaggacgaugcgguucauuucuuuccacguuccgcagacgacucgcccga

SEQ ID NO: 14930 - RNA, 50 nt, Artificial Sequence
  Description of Artificial Sequence: Synthetic oligonucleotide
gggaggacgaugcgguuugggaguagggguuccgcagacgacucgcccga

SEQ ID NO: 14931 - RNA, 51 nt, Artificial Sequence
  Description of Artificial Sequence: Synthetic oligonucleotide
gggaggacgaugcggauucucuuucuuuuccaccgcagacgacucgcccga

SEQ ID NO: 14932 - RNA, 51 nt, Artificial Sequence
  Description of Artificial Sequence: Synthetic oligonucleotide
gggaggacgaugcggacaugacugaucaugugccccagacgacucgcccga

SEQ ID NO: 14933 - RNA, 51 nt, Artificial Sequence
  Description of Artificial Sequence: Synthetic oligonucleotide
gggaggacgaugcgguccuuucguucugcgcuccccagacgacucgcccga

SEQ ID NO: 14934 - RNA, 51 nt, Artificial Sequence
  Description of Artificial Sequence: Synthetic oligonucleotide
gggaggacgaugcgguccugucgucuguucuaccccagacgacucgcccga

SEQ ID NO: 14935 - RNA, 52 nt, Artificial Sequence
  Description of Artificial Sequence: Synthetic oligonucleotide
gggaggacgaugcgguuugggaguagggugguaccucagacgacucgcccga

SEQ ID NO: 14936 - RNA, 51 nt, Artificial Sequence
  Description of Artificial Sequence: Synthetic oligonucleotide
gggaggacgaugcgguccuuucguucugcccgccccagacgacucgcccga

SEQ ID NO: 14937 - RNA, 51 nt, Artificial Sequence
  Description of Artificial Sequence: Synthetic oligonucleotide
gggaggacgaugcgguccugucggcuauucguccccagacgacucgcccga

SEQ ID NO: 14938 - RNA, 51 nt, Artificial Sequence
  Description of Artificial Sequence: Synthetic oligonucleotide
gggaggacgaugcggguuguuuuaccuccccgccccagacgacucgcccga

SEQ ID NO: 14939 - RNA, 52 nt, Artificial Sequence
  Description of Artificial Sequence: Synthetic oligonucleotide
gggaggacgaugcgggccuauucguucugcccuccccagacgacucgcccga

SEQ ID NO: 14940 - RNA, 51 nt, Artificial Sequence
  Description of Artificial Sequence: Synthetic oligonucleotide
gggaggacgaugcggcccacuucuucucuauuccgcagacgacucgcccga

SEQ ID NO: 14941 - RNA, 51 nt, Artificial Sequence
  Description of Artificial Sequence: Synthetic oligonucleotide
gggaggacgaugcggauuuauuaccccuuuugccccagacgacucgcccga

SEQ ID NO: 14942 - RNA, 51 nt, Artificial Sequence
  Description of Artificial Sequence: Synthetic oligonucleotide
gggaggacgaugcggucuuuuuaaccuuuucuccgcagacgacucgcccga

SEQ ID NO: 14943 - RNA, 51 nt, Artificial Sequence
  Description of Artificial Sequence: Synthetic oligonucleotide
gggaggacgaugcgguauucucuugcuuuucuccgcagacgacucgcccga

SEQ ID NO: 14944 - RNA, 52 nt, Artificial Sequence
  Description of Artificial Sequence: Synthetic oligonucleotide
gggaggacgaugcggcauucucuuuuuuucuugccccagacgacucgcccga

SEQ ID NO: 14945 - RNA, 52 nt, Artificial Sequence
  Description of Artificial Sequence: Synthetic oligonucleotide
gggaggacgaugcggauucacuucuuuuucuugccgcagacgacucgcccga

SEQ ID NO: 14946 - RNA, 49 nt, Artificial Sequence
  Description of Artificial Sequence: Synthetic oligonucleotide
gggaggacgaugcgggcuuuucguugcccuccccagacgacucgcccga

SEQ ID NO: 14947 - RNA, 51 nt, Artificial Sequence
  Description of Artificial Sequence: Synthetic oligonucleotide
gggaggacgaugcggacauguaauaccaguggccccagacgacucgcccga

SEQ ID NO: 14948 - RNA, 49 nt, Artificial Sequence
  Description of Artificial Sequence: Synthetic oligonucleotide
gggaggacgaugcggauuucucuuucuuugccgcagacgacucgcccga

SEQ ID NO: 14949 - RNA, 50 nt, Artificial Sequence
  Description of Artificial Sequence: Synthetic oligonucleotide
gggaggacgaugcggccuuucguucugccccccccagacgacucgcccga

SEQ ID NO: 14950 - RNA, 51 nt, Artificial Sequence
  Description of Artificial Sequence: Synthetic oligonucleotide
gggaggacgaugcgguccuuucgaucugcccuccccagacgacucgcccga

SEQ ID NO: 14951 - RNA, 50 nt, Artificial Sequence
  Description of Artificial Sequence: Synthetic oligonucleotide
gggaggacgaugcgggcuuucguucugcucuccccagacgacucgcccga

SEQ ID NO: 14952 - RNA, 50 nt, Artificial Sequence
  Description of Artificial Sequence: Synthetic oligonucleotide
gggaggacgaugcgguccuuauguuccuccugcccagacgacucgcccga

SEQ ID NO: 14953 - RNA, 51 nt, Artificial Sequence
  Description of Artificial Sequence: Synthetic oligonucleotide
gggaggacgaugcggucugaaggguguuggguccgcagacgacucgcccga

SEQ ID NO: 14954 - RNA, 51 nt, Artificial Sequence
  Description of Artificial Sequence: Synthetic oligonucleotide
gggaggacgaugcggaagaugagguggcucgugcccagacgacucgcccga

SEQ ID NO: 14955 - RNA, 51 nt, Artificial Sequence
  Description of Artificial Sequence: Synthetic oligonucleotide
gggaggacgaugcggucuaacguuccuuccguccccagacgacucgcccga

SEQ ID NO: 14956 - RNA, 50 nt, Artificial Sequence
  Description of Artificial Sequence: Synthetic oligonucleotide
gggaggacgaugcgguugaagugugauggguccgcagacgacucgcccga

SEQ ID NO: 14957 - RNA, 51 nt, Artificial Sequence
  Description of Artificial Sequence: Synthetic oligonucleotide
gggaggacgaugcgguucuucaaauguuuuccccgcagacgacucgcccga

SEQ ID NO: 14958 - RNA, 51 nt, Artificial Sequence
  Description of Artificial Sequence: Synthetic oligonucleotide
gggaggacgaugcgguauuuucuuccuuuucuccgcagacgacucgcccga

SEQ ID NO: 14959 - RNA, 51 nt, Artificial Sequence
  Description of Artificial Sequence: Synthetic oligonucleotide
gggaggacgaugcgggccuuuauuuuccaucuccgcagacgacucgcccga

SEQ ID NO: 14960 - RNA, 51 nt, Artificial Sequence
  Description of Artificial Sequence: Synthetic oligonucleotide
gggaggacgaugcgguuugaaggguguuggcuccgcagacgacucgcccga

SEQ ID NO: 14961 - RNA, 51 nt, Artificial Sequence
  Description of Artificial Sequence: Synthetic oligonucleotide
gggaggacgaugcggauuaucuuuuccuuguuccgcagacgacucgcccga

SEQ ID NO: 14962 - RNA, 51 nt, Artificial Sequence
  Description of Artificial Sequence: Synthetic oligonucleotide
gggaggacgaugcgguuugaugggugcuggguccgcagacgacucgcccga

SEQ ID NO: 14963 - RNA, 51 nt, Artificial Sequence
  Description of Artificial Sequence: Synthetic oligonucleotide
gggaggacgaugcggucacaccuuuucucuauccgcagacgacucgcccga

SEQ ID NO: 14964 - RNA, 51 nt, Artificial Sequence
  Description of Artificial Sequence: Synthetic oligonucleotide
gggaggacgaugcggucuuauucuucucuucuccgcagacgacucgcccga

SEQ ID NO: 14965 - RNA, 51 nt, Artificial Sequence
  Description of Artificial Sequence: Synthetic oligonucleotide
gggaggacgaugcggccuuucuuccacuuuuugcccagacgacucgcccga

SEQ ID NO: 14966 - RNA, 51 nt, Artificial Sequence
  Description of Artificial Sequence: Synthetic oligonucleotide
gggaggacgaugcgguauuuacuucuuuuuguccgcagacgacucgcccga

SEQ ID NO: 14967 - RNA, 51 nt, Artificial Sequence
  Description of Artificial Sequence: Synthetic oligonucleotide
gggaggacgaugcgguguuuucuucuucuacugcccagacgacucgcccga

SEQ ID NO: 14968 - RNA, 51 nt, Artificial Sequence
  Description of Artificial Sequence: Synthetic oligonucleotide
gggaggacgaugcgguuauguuuguccuuuuuccgcagacgacucgcccga

SEQ ID NO: 14969 - RNA, 51 nt, Artificial Sequence
  Description of Artificial Sequence: Synthetic oligonucleotide
gggaggacgaugcgguucgaaaggugauggguccgcagacgacucgcccga

SEQ ID NO: 14970 - RNA, 51 nt, Artificial Sequence
  Description of Artificial Sequence: Synthetic oligonucleotide
gggaggacgaugcgguucuuaccgucuucuugccgcagacgacucgcccga

SEQ ID NO: 14971 - RNA, 51 nt, Artificial Sequence
  Description of Artificial Sequence: Synthetic oligonucleotide
gggaggacgaugcggaccuuuuuguucgcuuuccgcagacgacucgcccga

SEQ ID NO: 14972 - RNA, 51 nt, Artificial Sequence
  Description of Artificial Sequence: Synthetic oligonucleotide
gggaggacgaugcgggccuuucuuucuacccuccccagacgacucgcccga

SEQ ID NO: 14973 - RNA, 51 nt, Artificial Sequence
  Description of Artificial Sequence: Synthetic oligonucleotide
gggaggacgaugcggucuuaucuauuuucccgccccagacgacucgcccga

SEQ ID NO: 14974 - RNA, 51 nt, Artificial Sequence
  Description of Artificial Sequence: Synthetic oligonucleotide
gggaggacgaugcgggccuuucguucuucccuucccagacgacucgcccga

SEQ ID NO: 14975 - RNA, 51 nt, Artificial Sequence
  Description of Artificial Sequence: Synthetic oligonucleotide
gggaggacgaugcggcauuuuccuuauuuucggcccagacgacucgcccga

SEQ ID NO: 14976 - RNA, 52 nt, Artificial Sequence
  Description of Artificial Sequence: Synthetic oligonucleotide
gggaggacgaugcggaugguguguuuuaugcggcugcagacgacucgcccga

SEQ ID NO: 14977 - RNA, 51 nt, Artificial Sequence
  Description of Artificial Sequence: Synthetic oligonucleotide
gggaggacgaugcggguugguguaggaggguuccgcagacgacucgcccga

SEQ ID NO: 14978 - RNA, 51 nt, Artificial Sequence
  Description of Artificial Sequence: Synthetic oligonucleotide
gggaggacgaugcggcuuauggaguagggaggggccagacgacucgcccga

SEQ ID NO: 14979 - RNA, 51 nt, Artificial Sequence
  Description of Artificial Sequence: Synthetic oligonucleotide
gggaggacgaugcggcuguuuuuccuguuuguccccagacgacucgcccga

SEQ ID NO: 14980 - RNA, 51 nt, Artificial Sequence
  Description of Artificial Sequence: Synthetic oligonucleotide
gggaggacgaugcgguccuggcucgucguuguccccagacgacucgcccga

SEQ ID NO: 14981 - RNA, 52 nt, Artificial Sequence
  Description of Artificial Sequence: Synthetic oligonucleotide
gggaggacgaugcgggccuuucguucugcccugccccagacgacucgcccga

SEQ ID NO: 14982 - RNA, 51 nt, Artificial Sequence
  Description of Artificial Sequence: Synthetic oligonucleotide
gggaggacgaugcggacaguguaaugaucugugcccagacgacucgcccga

SEQ ID NO: 14983 - RNA, 51 nt, Artificial Sequence
  Description of Artificial Sequence: Synthetic oligonucleotide
gggaggacgaugcgguuugaacggugaugggcccgcagacgacucgcccga

SEQ ID NO: 14984 - RNA, 51 nt, Artificial Sequence
  Description of Artificial Sequence: Synthetic oligonucleotide
gggaggacgaugcgguuuggggggagguggguccgcagacgacucgcccga

SEQ ID NO: 14985 - RNA, 51 nt, Artificial Sequence
  Description of Artificial Sequence: Synthetic oligonucleotide
gggaggacgaugcgguuuacuuuuucuccaugccccagacgacucgcccga

SEQ ID NO: 14986 - RNA, 53 nt, Artificial Sequence
  Description of Artificial Sequence: Synthetic oligonucleotide
gggaggacgaugcgguuuacucguuauuuuuuugccgcagacgacucgcccga

SEQ ID NO: 14987 - RNA, 51 nt, Artificial Sequence
  Description of Artificial Sequence: Synthetic oligonucleotide
gggaggacgaugcggucuacauuucucuucuugcccagacgacucgcccga

SEQ ID NO: 14988 - RNA, 51 nt, Artificial Sequence
  Description of Artificial Sequence: Synthetic oligonucleotide
gggaggacgaugcgguccuugcucgucuuacacugcagacgacucgcccga

SEQ ID NO: 14989 - RNA, 50 nt, Artificial Sequence
  Description of Artificial Sequence: Synthetic oligonucleotide
gggaggacgaugcggaauuucucguuuuuugcugcagacgacucgcccga

SEQ ID NO: 14990 - RNA, 51 nt, Artificial Sequence
  Description of Artificial Sequence: Synthetic oligonucleotide
gggaggacgaugcgguuuucaucauauuucuccgccagacgacucgcccga

SEQ ID NO: 14991 - RNA, 50 nt, Artificial Sequence
  Description of Artificial Sequence: Synthetic oligonucleotide
gggaggacgaugcgguuguuuuucucuuuuuccgcagacgacucgcccga

SEQ ID NO: 14992 - RNA, 51 nt, Artificial Sequence
  Description of Artificial Sequence: Synthetic oligonucleotide
gggaggacgaugcgguuguuuucaguguuuguccgcagacgacucgcccga

SEQ ID NO: 14993 - RNA, 51 nt, Artificial Sequence
  Description of Artificial Sequence: Synthetic oligonucleotide
gggaggacgaugcggauuaucuuuuccacuuaccccagacgacucgcccga

SEQ ID NO: 14994 - RNA, 51 nt, Artificial Sequence
  Description of Artificial Sequence: Synthetic oligonucleotide
gggaggacgaugcgggacuuuuuaauuccuuaccccagacgacucgcccga

SEQ ID NO: 14995 - RNA, 53 nt, Artificial Sequence
  Description of Artificial Sequence: Synthetic oligonucleotide
gggaggacgaugcggucucuuuauuuuuuuucuuccgcagacgacucgcccga

SEQ ID NO: 14996 - RNA, 51 nt, Artificial Sequence
  Description of Artificial Sequence: Synthetic oligonucleotide
gggaggacgaugcgggaguuuguauguuuuugccccagacgacucgcccga

SEQ ID NO: 14997 - RNA, 52 nt, Artificial Sequence
  Description of Artificial Sequence: Synthetic oligonucleotide
gggaggacgaugcggcuuuuugcucuuuuuucuccgcagacgacucgcccga

SEQ ID NO: 14998 - RNA, 51 nt, Artificial Sequence
  Description of Artificial Sequence: Synthetic oligonucleotide
gggaggacgaugcggaauuuuauuuuaccucacugcagacgacucgcccga

SEQ ID NO: 14999 - RNA, 51 nt, Artificial Sequence
  Description of Artificial Sequence: Synthetic oligonucleotide
gggaggacgaugcggccauuuuacguuuacuuccgcagacgacucgcccga

SEQ ID NO: 15000 - RNA, 51 nt, Artificial Sequence
  Description of Artificial Sequence: Synthetic oligonucleotide
gggaggacgaugcggcuuauauaucacuuucuccgcagacgacucgcccga

SEQ ID NO: 15001 - RNA, 51 nt, Artificial Sequence
  Description of Artificial Sequence: Synthetic oligonucleotide
gggaggacgaugcggaauuuuucacuuuuuaaccccagacgacucgcccga

SEQ ID NO: 15002 - RNA, 52 nt, Artificial Sequence
  Description of Artificial Sequence: Synthetic oligonucleotide
gggaggacgaugcggaguauuuuuucuccguuuccgcagacgacucgcccga

SEQ ID NO: 15003 - RNA, 51 nt, Artificial Sequence
  Description of Artificial Sequence: Synthetic oligonucleotide
gggaggacgaugcgguuuucuacguugcuuuuccccagacgacucgcccga

SEQ ID NO: 15004 - RNA, 50 nt, Artificial Sequence
  Description of Artificial Sequence: Synthetic oligonucleotide
gggaggacgaugcggcuuuuuuuauucgucuccgcagacgacucgcccga

SEQ ID NO: 15005 - RNA, 51 nt, Artificial Sequence
  Description of Artificial Sequence: Synthetic oligonucleotide
gggaggacgaugcggcucuuuucaauguuuuaccgcagacgacucgcccga

SEQ ID NO: 15006 - RNA, 51 nt, Artificial Sequence
  Description of Artificial Sequence: Synthetic oligonucleotide
gggaggacgaugcgggucuuucuuucauuuuuccccagacgacucgcccga

SEQ ID NO: 15007 - RNA, 51 nt, Artificial Sequence
  Description of Artificial Sequence: Synthetic oligonucleotide
gggaggacgaugcggcuuugcuuuaucuucuuccgcagacgacucgcccga

SEQ ID NO: 15008 - RNA, 49 nt, Artificial Sequence
  Description of Artificial Sequence: Synthetic oligonucleotide
gggaggacgaugcgguguuuguuuuuuuuugugcagacgacucgcccga

SEQ ID NO: 15009 - RNA, 51 nt, Artificial Sequence
  Description of Artificial Sequence: Synthetic oligonucleotide
gggaggacgaugcgguugucuauucucuuucgccgcagacgacucgcccga

SEQ ID NO: 15010 - RNA, 51 nt, Artificial Sequence
  Description of Artificial Sequence: Synthetic oligonucleotide
gggaggacgaugcggacuuuucucuacuuucaccgcagacgacucgcccga

SEQ ID NO: 15011 - RNA, 51 nt, Artificial Sequence
  Description of Artificial Sequence: Synthetic oligonucleotide
gggaggacgaugcgggaacuuauucuuuuucgccccagacgacucgcccga

SEQ ID NO: 15012 - RNA, 51 nt, Artificial Sequence
  Description of Artificial Sequence: Synthetic oligonucleotide
gggaggacgaugcggaucuuaugcuauuuucuccgcagacgacucgcccga

SEQ ID NO: 15013 - RNA, 51 nt, Artificial Sequence
  Description of Artificial Sequence: Synthetic oligonucleotide
gggaggacgaugcgguuuguagggugcuggguccgcagacgacucgcccga

SEQ ID NO: 15014 - RNA, 51 nt, Artificial Sequence
  Description of Artificial Sequence: Synthetic oligonucleotide
gggaggacgaugcggguauguuuuuauuuguuccgcagacgacucgcccga

SEQ ID NO: 15015 - RNA, 51 nt, Artificial Sequence
  Description of Artificial Sequence: Synthetic oligonucleotide
gggaggacgaugcggauuuguuuauucuccuuccgcagacgacucgcccga

SEQ ID NO: 15016 - RNA, 52 nt, Artificial Sequence
  Description of Artificial Sequence: Synthetic oligonucleotide
gggaggacgaugcgguuuuuucauuuuaccguuccgcagacgacucgcccga

SEQ ID NO: 15017 - RNA, 51 nt, Artificial Sequence
  Description of Artificial Sequence: Synthetic oligonucleotide
gggaggacgaugcggcaucuuauucuuuccaaccgcagacgacucgcccga

SEQ ID NO: 15018 - RNA, 52 nt, Artificial Sequence
  Description of Artificial Sequence: Synthetic oligonucleotide
gggaggacgaugcggaguuuacuaucucuguuuccgcagacgacucgcccga

SEQ ID NO: 15019 - RNA, 51 nt, Artificial Sequence
  Description of Artificial Sequence: Synthetic oligonucleotide
gggaggacgaugcgguuguuuuuguuugugucccgcagacgacucgcccga

SEQ ID NO: 15020 - RNA, 52 nt, Artificial Sequence
  Description of Artificial Sequence: Synthetic oligonucleotide
gggaggacgaugcgguuuuuuuauucaccuucuccgcagacgacucgcccga

SEQ ID NO: 15021 - RNA, 51 nt, Artificial Sequence
  Description of Artificial Sequence: Synthetic oligonucleotide
gggaggacgaugcgguuugcuccuucuuauuuccgcagacgacucgcccga

SEQ ID NO: 15022 - RNA, 51 nt, Artificial Sequence
  Description of Artificial Sequence: Synthetic oligonucleotide
gggaggacgaugcgggcuguuauuuuuguuauccgcagacgacucgcccga

SEQ ID NO: 15023 - RNA, 51 nt, Artificial Sequence
  Description of Artificial Sequence: Synthetic oligonucleotide
gggaggacgaugcggacugauuucucuuuuacccccagacgacucgcccga

SEQ ID NO: 15024 - RNA, 51 nt, Artificial Sequence
  Description of Artificial Sequence: Synthetic oligonucleotide
gggaggacgaugcggcucuuaccaugcuuucuccgcagacgacucgcccga

SEQ ID NO: 15025 - RNA, 52 nt, Artificial Sequence
  Description of Artificial Sequence: Synthetic oligonucleotide
gggaggacgaugcgggauuuguuuuuuguuuugugccagacgacucgcccga

SEQ ID NO: 15026 - RNA, 52 nt, Artificial Sequence
  Description of Artificial Sequence: Synthetic oligonucleotide
gggaggacgaugcgguuuuaucuuuuguuuuuugcgcagacgacucgcccga

SEQ ID NO: 15027 - RNA, 53 nt, Artificial Sequence
  Description of Artificial Sequence: Synthetic oligonucleotide
gggaggacgaugcgguuuguuuuucucuuuuuuuccgcagacgacucgcccga

SEQ ID NO: 15028 - RNA, 51 nt, Artificial Sequence
  Description of Artificial Sequence: Synthetic oligonucleotide
gggaggacgaugcggucaucuuauauuccuuuccgcagacgacucgcccga

SEQ ID NO: 15029 - RNA, 51 nt, Artificial Sequence
  Description of Artificial Sequence: Synthetic oligonucleotide
gggaggacgaugcgguauuuucgaguauuuuuccgcagacgacucgcccga

SEQ ID NO: 15030 - RNA, 51 nt, Artificial Sequence
  Description of Artificial Sequence: Synthetic oligonucleotide
gggaggacgaugcggguuucccuuguuugcuuccgcagacgacucgcccga

SEQ ID NO: 15031 - RNA, 51 nt, Artificial Sequence
  Description of Artificial Sequence: Synthetic oligonucleotide
gggaggacgaugcggagaggaggaguugggaucugcagacgacucgcccga

SEQ ID NO: 15032 - RNA, 51 nt, Artificial Sequence
  Description of Artificial Sequence: Synthetic oligonucleotide
gggaggacgaugcggaauuuacauuacucuuugcccagacgacucgcccga

SEQ ID NO: 15033 - RNA, 51 nt, Artificial Sequence
  Description of Artificial Sequence: Synthetic oligonucleotide
gggaggacgaugcgggcccuucucgucuuauacugcagacgacucgcccga

SEQ ID NO: 15034 - RNA, 51 nt, Artificial Sequence
  Description of Artificial Sequence: Synthetic oligonucleotide
gggaggacgaugcggaucuuuauuuuuuuucuccgcagacgacucgcccga

SEQ ID NO: 15035 - RNA, 51 nt, Artificial Sequence
  Description of Artificial Sequence: Synthetic oligonucleotide
gggaggacgaugcggacccuuuuauuuucuugccgcagacgacucgcccga

SEQ ID NO: 15036 - RNA, 50 nt, Artificial Sequence
  Description of Artificial Sequence: Synthetic oligonucleotide
gggaggacgaugcgguacuuuuuuuuucucuccgcagacgacucgcccga

SEQ ID NO: 15037 - RNA, 51 nt, Artificial Sequence
  Description of Artificial Sequence: Synthetic oligonucleotide
gggaggacgaugcggccuuuuacuuuucuucuccgcagacgacucgcccga

SEQ ID NO: 15038 - RNA, 51 nt, Artificial Sequence
  Description of Artificial Sequence: Synthetic oligonucleotide
gggaggacgaugcggcuuuacuucuuuccuuuccccagacgacucgcccga

SEQ ID NO: 15039 - RNA, 52 nt, Artificial Sequence
  Description of Artificial Sequence: Synthetic oligonucleotide
gggaggacgaugcggaccgcuguuuauuuuuuuccgcagacgacucgcccga

SEQ ID NO: 15040 - RNA, 51 nt, Artificial Sequence
  Description of Artificial Sequence: Synthetic oligonucleotide
gggaggacgaugcggucccauuucauuucuugccccagacgacucgcccga

SEQ ID NO: 15041 - RNA, 50 nt, Artificial Sequence
  Description of Artificial Sequence: Synthetic oligonucleotide
gggaggacgaugcggauucgcuuacuauuuaccgcagacgacucgcccga

SEQ ID NO: 15042 - RNA, 51 nt, Artificial Sequence
  Description of Artificial Sequence: Synthetic oligonucleotide
gggaggacgaugcggccuuauuuuuuguuucccaccagacgacucgcccga

SEQ ID NO: 15043 - RNA, 51 nt, Artificial Sequence
  Description of Artificial Sequence: Synthetic oligonucleotide
gggaggacgaugcggauuauuuguuucaccuucaccagacgacucgcccga

SEQ ID NO: 15044 - RNA, 51 nt, Artificial Sequence
  Description of Artificial Sequence: Synthetic oligonucleotide
gggaggacgaugcgggccuuucguuucgcccuccccagacgacucgcccga

SEQ ID NO: 15045 - RNA, 52 nt, Artificial Sequence
  Description of Artificial Sequence: Synthetic oligonucleotide
gggaggacgaugcggguccugucgucugucuguccccagacgacucgcccga

SEQ ID NO: 15046 - RNA, 51 nt, Artificial Sequence
  Description of Artificial Sequence: Synthetic oligonucleotide
gggaggacgaugcgggccuuucgcucuucccuccccagacgacucgcccga

SEQ ID NO: 15047 - RNA, 51 nt, Artificial Sequence
  Description of Artificial Sequence: Synthetic oligonucleotide
gggaggacgaugcggcacucucuucauucacuccgcagacgacucgcccga

SEQ ID NO: 15048 - RNA, 51 nt, Artificial Sequence
  Description of Artificial Sequence: Synthetic oligonucleotide
gggaggacgaugcgggccuuucguucugccccucccagacgacucgcccga

SEQ ID NO: 15049 - RNA, 51 nt, Artificial Sequence
  Description of Artificial Sequence: Synthetic oligonucleotide
gggaggacgaugcgggucuucugguuuaucguccccagacgacucgcccga

SEQ ID NO: 15050 - RNA, 51 nt, Artificial Sequence
  Description of Artificial Sequence: Synthetic oligonucleotide
gggaggacgaugcggcuuauuuucacuugcuaccccagacgacucgcccga

SEQ ID NO: 15051 - RNA, 52 nt, Artificial Sequence
  Description of Artificial Sequence: Synthetic oligonucleotide
gggaggacgaugcgguuuuucacuuuuuucgccccccagacgacucgcccga

SEQ ID NO: 15052 - RNA, 51 nt, Artificial Sequence
  Description of Artificial Sequence: Synthetic oligonucleotide
gggaggacgaugcggucuuuuuauucuauccccugcagacgacucgcccga

SEQ ID NO: 15053 - RNA, 51 nt, Artificial Sequence
  Description of Artificial Sequence: Synthetic oligonucleotide
gggaggacgaugcgguuuauuguuuucuucgugcccagacgacucgcccga

SEQ ID NO: 15054 - RNA, 51 nt, Artificial Sequence
  Description of Artificial Sequence: Synthetic oligonucleotide
gggaggacgaugcggucuuguuuguucuuucuccgcagacgacucgcccga

SEQ ID NO: 15055 - RNA, 51 nt, Artificial Sequence
  Description of Artificial Sequence: Synthetic oligonucleotide
gggaggacgaugcggccuuucuucgcuuuuuaccgcagacgacucgcccga

SEQ ID NO: 15056 - RNA, 51 nt, Artificial Sequence
  Description of Artificial Sequence: Synthetic oligonucleotide
gggaggacgaugcggauauucuaguuuucuuugcccagacgacucgcccga

SEQ ID NO: 15057 - RNA, 52 nt, Artificial Sequence
  Description of Artificial Sequence: Synthetic oligonucleotide
gggaggacgaugcgguuuuuguuauuuuuugcucugcagacgacucgcccga

SEQ ID NO: 15058 - RNA, 51 nt, Artificial Sequence
  Description of Artificial Sequence: Synthetic oligonucleotide
gggaggacgaugcggauccuugcuauuucucucugcagacgacucgcccga

SEQ ID NO: 15059 - RNA, 51 nt, Artificial Sequence
  Description of Artificial Sequence: Synthetic oligonucleotide
gggaggacgaugcggccuauuccuuuucaccuccgcagacgacucgcccga

SEQ ID NO: 15060 - RNA, 51 nt, Artificial Sequence
  Description of Artificial Sequence: Synthetic oligonucleotide
gggaggacgaugcggucuuuauuucucuuguucgccagacgacucgcccga

SEQ ID NO: 15061 - RNA, 52 nt, Artificial Sequence
  Description of Artificial Sequence: Synthetic oligonucleotide
gggaggacgaugcggaauacucuuuuuuuuccaccgcagacgacucgcccga

SEQ ID NO: 15062 - RNA, 51 nt, Artificial Sequence
  Description of Artificial Sequence: Synthetic oligonucleotide
gggaggacgaugcgguuuuuuauucucucgcugcgcagacgacucgcccga

SEQ ID NO: 15063 - RNA, 50 nt, Artificial Sequence
  Description of Artificial Sequence: Synthetic oligonucleotide
gggaggacgaugcggaccuuucguucugccuccccagacgacucgcccga

SEQ ID NO: 15064 - RNA, 52 nt, Artificial Sequence
  Description of Artificial Sequence: Synthetic oligonucleotide
gggaggacgaugcggauucuuuuuuguuuuuuugcccagacgacucgcccga

SEQ ID NO: 15065 - RNA, 51 nt, Artificial Sequence
  Description of Artificial Sequence: Synthetic oligonucleotide
gggaggacgaugcgguuuggaggguuauggguccgcagacgacucgcccga

SEQ ID NO: 15066 - RNA, 51 nt, Artificial Sequence
  Description of Artificial Sequence: Synthetic oligonucleotide
gggaggacgaugcgguaucguauuucccuugucgccagacgacucgcccga

SEQ ID NO: 15067 - RNA, 51 nt, Artificial Sequence
  Description of Artificial Sequence: Synthetic oligonucleotide
gggaggacgaugcgguuugaaggggcauggguccgcagacgacucgcccga

SEQ ID NO: 15068 - RNA, 51 nt, Artificial Sequence
  Description of Artificial Sequence: Synthetic oligonucleotide
gggaggacgaugcgguuauaggaguggugguggugcagacgacucgcccga

SEQ ID NO: 15069 - RNA, 50 nt, Artificial Sequence
  Description of Artificial Sequence: Synthetic oligonucleotide
gggaggacgaugcgguacuucuuuuuucucuccgcagacgacucgcccga

SEQ ID NO: 15070 - RNA, 51 nt, Artificial Sequence
  Description of Artificial Sequence: Synthetic oligonucleotide
gggaggacgaugcgguuugaagggugauugcuccgcagacgacucgcccga

SEQ ID NO: 15071 - RNA, 51 nt, Artificial Sequence
  Description of Artificial Sequence: Synthetic oligonucleotide
gggaggacgaugcgguuugaugggugauggcuccgcagacgacucgcccga

SEQ ID NO: 15072 - RNA, 51 nt, Artificial Sequence
  Description of Artificial Sequence: Synthetic oligonucleotide
gggaggacgaugcggauugcagggugauggguccgcagacgacucgcccga

SEQ ID NO: 15073 - RNA, 51 nt, Artificial Sequence
  Description of Artificial Sequence: Synthetic oligonucleotide
gggaggacgaugcggucacuuacuuuuuuccuccgcagacgacucgcccga

SEQ ID NO: 15074 - RNA, 51 nt, Artificial Sequence
  Description of Artificial Sequence: Synthetic oligonucleotide
gggaggacgaugcggauuuccucuuuuuucugccgcagacgacucgcccga

SEQ ID NO: 15075 - RNA, 51 nt, Artificial Sequence
  Description of Artificial Sequence: Synthetic oligonucleotide
gggaggacgaugcgguauuaggaguagguagggugcagacgacucgcccga

SEQ ID NO: 15076 - RNA, 50 nt, Artificial Sequence
  Description of Artificial Sequence: Synthetic oligonucleotide
gggaggacgaugcggucuuuuuauuugcuuuccgcagacgacucgcccga

SEQ ID NO: 15077 - RNA, 51 nt, Artificial Sequence
  Description of Artificial Sequence: Synthetic oligonucleotide
gggaggacgaugcggccuuuuacuucuuuucuccgcagacgacucgcccga

SEQ ID NO: 15078 - RNA, 51 nt, Artificial Sequence
  Description of Artificial Sequence: Synthetic oligonucleotide
gggaggacgaugcggucuuugucuuguuuuuuccgcagacgacucgcccga

SEQ ID NO: 15079 - RNA, 51 nt, Artificial Sequence
  Description of Artificial Sequence: Synthetic oligonucleotide
gggaggacgaugcgguuuuacauuuacuuuuucgccagacgacucgcccga

SEQ ID NO: 15080 - RNA, 51 nt, Artificial Sequence
  Description of Artificial Sequence: Synthetic oligonucleotide
gggaggacgaugcggguucuuacuuucuuuucgcccagacgacucgcccga

SEQ ID NO: 15081 - RNA, 52 nt, Artificial Sequence
  Description of Artificial Sequence: Synthetic oligonucleotide
gggaggacgaugcggcuuuuuugcucuuuuucuccgcagacgacucgcccga

SEQ ID NO: 15082 - RNA, 51 nt, Artificial Sequence
  Description of Artificial Sequence: Synthetic oligonucleotide
gggaggacgaugcggaucuacauuacuucuuaccccagacgacucgcccga

SEQ ID NO: 15083 - RNA, 51 nt, Artificial Sequence
  Description of Artificial Sequence: Synthetic oligonucleotide
gggaggacgaugcggguuguuuuauuuuuuguccccagacgacucgcccga

SEQ ID NO: 15084 - RNA, 53 nt, Artificial Sequence
  Description of Artificial Sequence: Synthetic oligonucleotide
gggaggacgaugcggauuccacuuuuuuuuuccaccgcagacgacucgcccga

SEQ ID NO: 15085 - RNA, 50 nt, Artificial Sequence
  Description of Artificial Sequence: Synthetic oligonucleotide
gggaggacgaugcgguuuauauuuugugcuucuccagacgacucgcccga

SEQ ID NO: 15086 - RNA, 49 nt, Artificial Sequence
  Description of Artificial Sequence: Synthetic oligonucleotide
gggaggacgaugcgguuucucuuuuucuuuccgcagacgacucgcccga

SEQ ID NO: 15087 - RNA, 51 nt, Artificial Sequence
  Description of Artificial Sequence: Synthetic oligonucleotide
gggaggacgaugcgguuuuaagggugcuggguccgcagacgacucgcccga

SEQ ID NO: 15088 - RNA, 51 nt, Artificial Sequence
  Description of Artificial Sequence: Synthetic oligonucleotide
gggaggacgaugcgguuauguuucucccguggccgcagacgacucgcccga

SEQ ID NO: 15089 - RNA, 53 nt, Artificial Sequence
  Description of Artificial Sequence: Synthetic oligonucleotide
gggaggacgaugcggaguuuuuugucuuuuuuucccccagacgacucgcccga

SEQ ID NO: 15090 - RNA, 51 nt, Artificial Sequence
  Description of Artificial Sequence: Synthetic oligonucleotide
gggaggacgaugcgguuuccauuucauuauuuccccagacgacucgcccga

SEQ ID NO: 15091 - RNA, 51 nt, Artificial Sequence
  Description of Artificial Sequence: Synthetic oligonucleotide
gggaggacgaugcgguuuacuuuacauuuugcccacagacgacucgcccga

SEQ ID NO: 15092 - RNA, 52 nt, Artificial Sequence
  Description of Artificial Sequence: Synthetic oligonucleotide
gggaggacgaugcgguuuguuuuuauuuuuuguccccagacgacucgcccga

SEQ ID NO: 15093 - RNA, 51 nt, Artificial Sequence
  Description of Artificial Sequence: Synthetic oligonucleotide
gggaggacgaugcgguuugaagggcgauggguucgcagacgacucgcccga

SEQ ID NO: 15094 - RNA, 53 nt, Artificial Sequence
  Description of Artificial Sequence: Synthetic oligonucleotide
gggaggacgaugcggucuauuugguacuuuuuuuccgcagacgacucgcccga

SEQ ID NO: 15095 - RNA, 51 nt, Artificial Sequence
  Description of Artificial Sequence: Synthetic oligonucleotide
gggaggacgaugcgguucgucacugcuccuguccgcagacgacucgcccga

SEQ ID NO: 15096 - RNA, 51 nt, Artificial Sequence
  Description of Artificial Sequence: Synthetic oligonucleotide
gggaggacgaugcggucuuuacuuucucuuugccccagacgacucgcccga

SEQ ID NO: 15097 - RNA, 51 nt, Artificial Sequence
  Description of Artificial Sequence: Synthetic oligonucleotide
gggaggacgaugcgguuugaucaauucucccugcccagacgacucgcccga

SEQ ID NO: 15098 - RNA, 51 nt, Artificial Sequence
  Description of Artificial Sequence: Synthetic oligonucleotide
gggaggacgaugcgguuugaggguugauggguccgcagacgacucgcccga

SEQ ID NO: 15099 - RNA, 51 nt, Artificial Sequence
  Description of Artificial Sequence: Synthetic oligonucleotide
gggaggacgaugcgguccugucgucugcucggccccagacgacucgcccga

SEQ ID NO: 15100 - RNA, 51 nt, Artificial Sequence
  Description of Artificial Sequence: Synthetic oligonucleotide
gggaggacgaugcgguuugauucuuuuuguuuccgcagacgacucgcccga

SEQ ID NO: 15101 - RNA, 51 nt, Artificial Sequence
  Description of Artificial Sequence: Synthetic oligonucleotide
gggaggacgaugcgguucugucgucuuugcguccccagacgacucgcccga

SEQ ID NO: 15102 - RNA, 51 nt, Artificial Sequence
  Description of Artificial Sequence: Synthetic oligonucleotide
gggaggacgaugcggaaacuaguaguacuggugcccagacgacucgcccga

SEQ ID NO: 15103 - RNA, 51 nt, Artificial Sequence
  Description of Artificial Sequence: Synthetic oligonucleotide
gggaggacgaugcggcauaggaguagggggguagccagacgacucgcccga

SEQ ID NO: 15104 - RNA, 50 nt, Artificial Sequence
  Description of Artificial Sequence: Synthetic oligonucleotide
gggaggacgaugcggauuaucuuuucuuguuccgcagacgacucgcccga

SEQ ID NO: 15105 - RNA, 51 nt, Artificial Sequence
  Description of Artificial Sequence: Synthetic oligonucleotide
gggaggacgaugcgguuugcgaguaggguguuccgcagacgacucgcccga

SEQ ID NO: 15106 - RNA, 50 nt, Artificial Sequence
  Description of Artificial Sequence: Synthetic oligonucleotide
gggaggacgaugcgggccuuucguucuacccucccagacgacucgcccga

SEQ ID NO: 15107 - RNA, 51 nt, Artificial Sequence
  Description of Artificial Sequence: Synthetic oligonucleotide
gggaggacgaugcggguuuauucuuuuccgcuccgcagacgacucgcccga

SEQ ID NO: 15108 - RNA, 51 nt, Artificial Sequence
  Description of Artificial Sequence: Synthetic oligonucleotide
gggaggacgaugcggaagccaggagauguuguggccagacgacucgcccga

SEQ ID NO: 15109 - RNA, 51 nt, Artificial Sequence
  Description of Artificial Sequence: Synthetic oligonucleotide
gggaggacgaugcggcuuaaucuacuuccucuccgcagacgacucgcccga

SEQ ID NO: 15110 - RNA, 51 nt, Artificial Sequence
  Description of Artificial Sequence: Synthetic oligonucleotide
gggaggacgaugcggcgauuccuccgguucguccccagacgacucgcccga

SEQ ID NO: 15111 - RNA, 52 nt, Artificial Sequence
  Description of Artificial Sequence: Synthetic oligonucleotide
gggaggacgaugcgggugcucgucuguuuucguccccagacgacucgcccga

SEQ ID NO: 15112 - RNA, 51 nt, Artificial Sequence
  Description of Artificial Sequence: Synthetic oligonucleotide
gggaggacgaugcggacauacuuaauguguguccccagacgacucgcccga

SEQ ID NO: 15113 - RNA, 51 nt, Artificial Sequence
  Description of Artificial Sequence: Synthetic oligonucleotide
gggaggacgaugcgguucuggcuugucguuguccgcagacgacucgcccga

SEQ ID NO: 15114 - RNA, 51 nt, Artificial Sequence
  Description of Artificial Sequence: Synthetic oligonucleotide
gggaggacgaugcggaacguguuauuuacgugccccagacgacucgcccga

SEQ ID NO: 15115 - RNA, 52 nt, Artificial Sequence
  Description of Artificial Sequence: Synthetic oligonucleotide
gggaggacgaugcgguuuuuccauauucucuguccucagacgacucgcccga

SEQ ID NO: 15116 - RNA, 51 nt, Artificial Sequence
  Description of Artificial Sequence: Synthetic oligonucleotide
gggaggacgaugcggcacuacuuuucuacucuccgcagacgacucgcccga

SEQ ID NO: 15117 - RNA, 51 nt, Artificial Sequence
  Description of Artificial Sequence: Synthetic oligonucleotide
gggaggacgaugcggacuuuuuuucauuuuuugugcagacgacucgcccga

SEQ ID NO: 15118 - RNA, 51 nt, Artificial Sequence
  Description of Artificial Sequence: Synthetic oligonucleotide
gggaggacgaugcgguacuuacaauuuucucucugcagacgacucgcccga

SEQ ID NO: 15119 - RNA, 51 nt, Artificial Sequence
  Description of Artificial Sequence: Synthetic oligonucleotide
gggaggacgaugcggauucuuucacucuauuucugcagacgacucgcccga

SEQ ID NO: 15120 - RNA, 51 nt, Artificial Sequence
  Description of Artificial Sequence: Synthetic oligonucleotide
gggaggacgaugcggguccugucgccuuacguccccagacgacucgcccga

SEQ ID NO: 15121 - RNA, 50 nt, Artificial Sequence
  Description of Artificial Sequence: Synthetic oligonucleotide
gggaggacgaugcggccauucacuuucuuuuccgcagacgacucgcccga

SEQ ID NO: 15122 - RNA, 52 nt, Artificial Sequence
  Description of Artificial Sequence: Synthetic oligonucleotide
gggaggacgaugcgguucacuuuuuuccucauuccgcagacgacucgcccga

SEQ ID NO: 15123 - RNA, 52 nt, Artificial Sequence
  Description of Artificial Sequence: Synthetic oligonucleotide
gggaggacgaugcggaccuuuuccauuuuuuuuccgcagacgacucgcccga

SEQ ID NO: 15124 - RNA, 51 nt, Artificial Sequence
  Description of Artificial Sequence: Synthetic oligonucleotide
gggaggacgaugcggucuauuuaauuucuuuccugcagacgacucgcccga

SEQ ID NO: 15125 - RNA, 51 nt, Artificial Sequence
  Description of Artificial Sequence: Synthetic oligonucleotide
gggaggacgaugcggucacuuuuccuuuucauccacagacgacucgcccga

SEQ ID NO: 15126 - RNA, 52 nt, Artificial Sequence
  Description of Artificial Sequence: Synthetic oligonucleotide
gggaggacgaugcgguuuuuuugccuucucucuccgcagacgacucgcccga

SEQ ID NO: 15127 - RNA, 51 nt, Artificial Sequence
  Description of Artificial Sequence: Synthetic oligonucleotide
gggaggacgaugcgguuacuucuuguuuucuccugcagacgacucgcccga

SEQ ID NO: 15128 - RNA, 51 nt, Artificial Sequence
  Description of Artificial Sequence: Synthetic oligonucleotide
gggaggacgaugcgguauacucuucauuccuuccgcagacgacucgcccga

SEQ ID NO: 15129 - RNA, 51 nt, Artificial Sequence
  Description of Artificial Sequence: Synthetic oligonucleotide
gggaggacgaugcggaaugcucgaccuuccugccgcagacgacucgcccga

SEQ ID NO: 15130 - RNA, 51 nt, Artificial Sequence
  Description of Artificial Sequence: Synthetic oligonucleotide
gggaggacgaugcggucucuauucuucuuuucccccagacgacucgcccga

SEQ ID NO: 15131 - RNA, 51 nt, Artificial Sequence
  Description of Artificial Sequence: Synthetic oligonucleotide
gggaggacgaugcgguaauuuguuguuuauuugugcagacgacucgcccga

SEQ ID NO: 15132 - RNA, 52 nt, Artificial Sequence
  Description of Artificial Sequence: Synthetic oligonucleotide
gggaggacgaugcggucuuuuuuucauuuuuuuccgcagacgacucgcccga

SEQ ID NO: 15133 - RNA, 52 nt, Artificial Sequence
  Description of Artificial Sequence: Synthetic oligonucleotide
gggaggacgaugcgggucuuuuuuuuccgcuccccgcagacgacucgcccga

SEQ ID NO: 15134 - RNA, 50 nt, Artificial Sequence
  Description of Artificial Sequence: Synthetic oligonucleotide
gggaggacgaugcggcuucuuuuucuucuuuccgcagacgacucgcccga

SEQ ID NO: 15135 - RNA, 51 nt, Artificial Sequence
  Description of Artificial Sequence: Synthetic oligonucleotide
gggaggacgaugcggucuuuauaauuuucuccgugcagacgacucgcccga

SEQ ID NO: 15136 - RNA, 52 nt, Artificial Sequence
  Description of Artificial Sequence: Synthetic oligonucleotide
gggaggacgaugcggauuuccucuuuuuuucugccgcagacgacucgcccga

SEQ ID NO: 15137 - RNA, 50 nt, Artificial Sequence
  Description of Artificial Sequence: Synthetic oligonucleotide
gggaggacgaugcggccuuuuucuuccuuuuccgcagacgacucgcccga

SEQ ID NO: 15138 - RNA, 51 nt, Artificial Sequence
  Description of Artificial Sequence: Synthetic oligonucleotide
gggaggacgaugcggucuuuaauucucuucacccccagacgacucgcccga

SEQ ID NO: 15139 - RNA, 51 nt, Artificial Sequence
  Description of Artificial Sequence: Synthetic oligonucleotide
gggaggacgaugcggaucacuauuuaauuccaccgcagacgacucgcccga

SEQ ID NO: 15140 - RNA, 51 nt, Artificial Sequence
  Description of Artificial Sequence: Synthetic oligonucleotide
gggaggacgaugcgguuuucauucacuucacucugcagacgacucgcccga

SEQ ID NO: 15141 - RNA, 49 nt, Artificial Sequence
  Description of Artificial Sequence: Synthetic oligonucleotide
gggaggacgaugcggguuauuucuuuuuugcugcagacgacucgcccga

SEQ ID NO: 15142 - RNA, 51 nt, Artificial Sequence
  Description of Artificial Sequence: Synthetic oligonucleotide
gggaggacgaugcgguucaaucauuucuucucgugcagacgacucgcccga

SEQ ID NO: 15143 - RNA, 51 nt, Artificial Sequence
  Description of Artificial Sequence: Synthetic oligonucleotide
gggaggacgaugcggaguuccuuuucuacuuuccgcagacgacucgcccga

SEQ ID NO: 15144 - RNA, 51 nt, Artificial Sequence
  Description of Artificial Sequence: Synthetic oligonucleotide
gggaggacgaugcggucacuuagucuuuuucucugcagacgacucgcccga

SEQ ID NO: 15145 - RNA, 51 nt, Artificial Sequence
  Description of Artificial Sequence: Synthetic oligonucleotide
gggaggacgaugcgguauucacucauuuuacuccgcagacgacucgcccga

SEQ ID NO: 15146 - RNA, 51 nt, Artificial Sequence
  Description of Artificial Sequence: Synthetic oligonucleotide
gggaggacgaugcggcucuuuuugcuucuuuugcccagacgacucgcccga

SEQ ID NO: 15147 - RNA, 51 nt, Artificial Sequence
  Description of Artificial Sequence: Synthetic oligonucleotide
gggaggacgaugcggauuucucuuccuuuuuaccgcagacgacucgcccga

SEQ ID NO: 15148 - RNA, 51 nt, Artificial Sequence
  Description of Artificial Sequence: Synthetic oligonucleotide
gggaggacgaugcggccauuuucuuucaucuuccgcagacgacucgcccga

SEQ ID NO: 15149 - RNA, 51 nt, Artificial Sequence
  Description of Artificial Sequence: Synthetic oligonucleotide
gggaggacgaugcgggauucuucacuuuuuaccugcagacgacucgcccga

SEQ ID NO: 15150 - RNA, 51 nt, Artificial Sequence
  Description of Artificial Sequence: Synthetic oligonucleotide
gggaggacgaugcggcaauuguuuuuuuucaccgccagacgacucgcccga

SEQ ID NO: 15151 - RNA, 51 nt, Artificial Sequence
  Description of Artificial Sequence: Synthetic oligonucleotide
gggaggacgaugcgguuugcuuuauuuuuuguccccagacgacucgcccga

SEQ ID NO: 15152 - RNA, 51 nt, Artificial Sequence
  Description of Artificial Sequence: Synthetic oligonucleotide
gggaggacgaugcggacuuaucuuucucacuaccccagacgacucgcccga

SEQ ID NO: 15153 - RNA, 51 nt, Artificial Sequence
  Description of Artificial Sequence: Synthetic oligonucleotide
gggaggacgaugcggcuuuuuaucaguuucuccgccagacgacucgcccga

SEQ ID NO: 15154 - RNA, 51 nt, Artificial Sequence
  Description of Artificial Sequence: Synthetic oligonucleotide
gggaggacgaugcgguuaauuuauuuucagcuccccagacgacucgcccga

SEQ ID NO: 15155 - RNA, 51 nt, Artificial Sequence
  Description of Artificial Sequence: Synthetic oligonucleotide
gggaggacgaugcggcauuuacauucuuucugcgccagacgacucgcccga

SEQ ID NO: 15156 - RNA, 51 nt, Artificial Sequence
  Description of Artificial Sequence: Synthetic oligonucleotide
gggaggacgaugcggauuuuuuuucuuuuuugccgcagacgacucgcccga

SEQ ID NO: 15157 - RNA, 52 nt, Artificial Sequence
  Description of Artificial Sequence: Synthetic oligonucleotide
gggaggacgaugcgguuuuuucaccuuuugcuuccgcagacgacucgcccga

SEQ ID NO: 15158 - RNA, 51 nt, Artificial Sequence
  Description of Artificial Sequence: Synthetic oligonucleotide
gggaggacgaugcggacuuucucuuaucucugcugcagacgacucgcccga

SEQ ID NO: 15159 - RNA, 51 nt, Artificial Sequence
  Description of Artificial Sequence: Synthetic oligonucleotide
gggaggacgaugcgguuuuccaguuugcuuuuccccagacgacucgcccga

SEQ ID NO: 15160 - RNA, 51 nt, Artificial Sequence
  Description of Artificial Sequence: Synthetic oligonucleotide
gggaggacgaugcggucuauuucgaauucucuccgcagacgacucgcccga

SEQ ID NO: 15161 - RNA, 51 nt, Artificial Sequence
  Description of Artificial Sequence: Synthetic oligonucleotide
gggaggacgaugcggcauuuucuccauuuucggcccagacgacucgcccga

SEQ ID NO: 15162 - RNA, 51 nt, Artificial Sequence
  Description of Artificial Sequence: Synthetic oligonucleotide
gggaggacgaugcgguucauuuucccguuuugccgcagacgacucgcccga

SEQ ID NO: 15163 - RNA, 51 nt, Artificial Sequence
  Description of Artificial Sequence: Synthetic oligonucleotide
gggaggacgaugcggucuuuuucguuuuuuuaccgcagacgacucgcccga

SEQ ID NO: 15164 - RNA, 50 nt, Artificial Sequence
  Description of Artificial Sequence: Synthetic oligonucleotide
gggaggacgaugcgggcccuucguucugccuccccagacgacucgcccga

SEQ ID NO: 15165 - RNA, 51 nt, Artificial Sequence
  Description of Artificial Sequence: Synthetic oligonucleotide
gggaggacgaugcggccuuacuuuuuucaccaccccagacgacucgcccga

SEQ ID NO: 15166 - RNA, 51 nt, Artificial Sequence
  Description of Artificial Sequence: Synthetic oligonucleotide
gggaggacgaugcggcauuuguccuguuuucaccgcagacgacucgcccga

SEQ ID NO: 15167 - RNA, 51 nt, Artificial Sequence
  Description of Artificial Sequence: Synthetic oligonucleotide
gggaggacgaugcgguauuuauuuuucuugccccgcagacgacucgcccga

SEQ ID NO: 15168 - RNA, 51 nt, Artificial Sequence
  Description of Artificial Sequence: Synthetic oligonucleotide
gggaggacgaugcggauuuuuguuacguugcuccgcagacgacucgcccga

SEQ ID NO: 15169 - RNA, 51 nt, Artificial Sequence
  Description of Artificial Sequence: Synthetic oligonucleotide
gggaggacgaugcgguuuacuuucuucuuuugccgcagacgacucgcccga

SEQ ID NO: 15170 - RNA, 52 nt, Artificial Sequence
  Description of Artificial Sequence: Synthetic oligonucleotide
gggaggacgaugcgguuuuuuguuauuuuugcucugcagacgacucgcccga

SEQ ID NO: 15171 - RNA, 51 nt, Artificial Sequence
  Description of Artificial Sequence: Synthetic oligonucleotide
gggaggacgaugcgguuuuacuuccucauuugccgcagacgacucgcccga

SEQ ID NO: 15172 - RNA, 53 nt, Artificial Sequence
  Description of Artificial Sequence: Synthetic oligonucleotide
gggaggacgaugcgguuuuuuuuccuaucucuguccgcagacgacucgcccga

SEQ ID NO: 15173 - RNA, 53 nt, Artificial Sequence
  Description of Artificial Sequence: Synthetic oligonucleotide
gggaggacgaugcgguugccuuuuauuuuuuuuuccgcagacgacucgcccga

SEQ ID NO: 15174 - RNA, 50 nt, Artificial Sequence
  Description of Artificial Sequence: Synthetic oligonucleotide
gggaggacgaugcgguuuuucuacucuuuuuccgcagacgacucgcccga

SEQ ID NO: 15175 - RNA, 51 nt, Artificial Sequence
  Description of Artificial Sequence: Synthetic oligonucleotide
gggaggacgaugcggauucucucuuuuuucugccgcagacgacucgcccga

SEQ ID NO: 15176 - RNA, 51 nt, Artificial Sequence
  Description of Artificial Sequence: Synthetic oligonucleotide
gggaggacgaugcggccuuuucuucauuuuuuccgcagacgacucgcccga

SEQ ID NO: 15177 - RNA, 50 nt, Artificial Sequence
  Description of Artificial Sequence: Synthetic oligonucleotide
gggaggacgaugcgggccuuucgcucugccuccccagacgacucgcccga

SEQ ID NO: 15178 - RNA, 51 nt, Artificial Sequence
  Description of Artificial Sequence: Synthetic oligonucleotide
gggaggacgaugcgguuugggguuuccccgugccgcagacgacucgcccga

SEQ ID NO: 15179 - RNA, 52 nt, Artificial Sequence
  Description of Artificial Sequence: Synthetic oligonucleotide
gggaggacgaugcgggccguuucguucugcccuccccagacgacucgcccga

SEQ ID NO: 15180 - RNA, 51 nt, Artificial Sequence
  Description of Artificial Sequence: Synthetic oligonucleotide
gggaggacgaugcgguuccuguuuccucugcuccccagacgacucgcccga

SEQ ID NO: 15181 - RNA, 51 nt, Artificial Sequence
  Description of Artificial Sequence: Synthetic oligonucleotide
gggaggacgaugcgggucuucuggcuuauuguccccagacgacucgcccga

SEQ ID NO: 15182 - RNA, 51 nt, Artificial Sequence
  Description of Artificial Sequence: Synthetic oligonucleotide
gggaggacgaugcggacagauggauaguugggguccagacgacucgcccga

SEQ ID NO: 15183 - RNA, 51 nt, Artificial Sequence
  Description of Artificial Sequence: Synthetic oligonucleotide
gggaggacgaugcggcugacauuauccugcauguccagacgacucgcccga

SEQ ID NO: 15184 - RNA, 51 nt, Artificial Sequence
  Description of Artificial Sequence: Synthetic oligonucleotide
gggaggacgaugcgguuugggaguagggugauccgcagacgacucgcccga

SEQ ID NO: 15185 - RNA, 53 nt, Artificial Sequence
  Description of Artificial Sequence: Synthetic oligonucleotide
gggaggacgaugcggacuuuauucucuuuuuuuuccgcagacgacucgcccga

SEQ ID NO: 15186 - RNA, 51 nt, Artificial Sequence
  Description of Artificial Sequence: Synthetic oligonucleotide
gggaggacgaugcgguuugaagggugauuguuccgcagacgacucgcccga

SEQ ID NO: 15187 - RNA, 52 nt, Artificial Sequence
  Description of Artificial Sequence: Synthetic oligonucleotide
gggaggacgaugcggauuucucuucuucuuuugccgcagacgacucgcccga

SEQ ID NO: 15188 - RNA, 51 nt, Artificial Sequence
  Description of Artificial Sequence: Synthetic oligonucleotide
gggaggacgaugcggcuugaagggugaaggguccgcagacgacucgcccga

SEQ ID NO: 15189 - RNA, 51 nt, Artificial Sequence
  Description of Artificial Sequence: Synthetic oligonucleotide
gggaggacgaugcggauucucuucuucuuuuaccgcagacgacucgcccga

SEQ ID NO: 15190 - RNA, 51 nt, Artificial Sequence
  Description of Artificial Sequence: Synthetic oligonucleotide
gggaggacgaugcgguuugaugggugacggguccgcagacgacucgcccga

SEQ ID NO: 15191 - RNA, 52 nt, Artificial Sequence
  Description of Artificial Sequence: Synthetic oligonucleotide
gggaggacgaugcggucuucuuuuuuucacuuuccgcagacgacucgcccga

SEQ ID NO: 15192 - RNA, 51 nt, Artificial Sequence
  Description of Artificial Sequence: Synthetic oligonucleotide
gggaggacgaugcgguuuauuuucuuguuguugugcagacgacucgcccga

What is claimed is:

1. A method for binding extracellular histone 3 (H3) or histone 4 (H4) in a subject having a histone-induced injury or disease comprising administering to the subject a composition comprising a physiologically acceptable carrier and
   (i) an aptamer having at least 95% identity to KU7 (SEQ ID NO: 7741), wherein the aptamer specifically targets extracellular H3 or H4, wherein the nucleotides are RNA; or
   (ii) a conjugate comprising an aptamer having at least 95% identity to KU7 (SEQ ID NO: 7741), wherein the aptamer specifically targets extracellular H3 or H4, wherein the nucleotides are RNA, wherein the nucleic acid molecule is linked to a therapeutic molecule.

2. The method of claim 1, wherein the administration is by intravenous injection or by inhalation.

3. The method of claim 1, wherein the composition is administered within 0-24 hours after an injury or diagnosis of disease.

4. The method of claim 3, wherein the injury is trauma, burn, transfusion-related acute lung injury, organ ischemia or infarction, or inhalation lung injury.

5. The method of claim 1, wherein the composition is administered more than one time.

6. The method of claim 1, wherein the disease is an autoimmune disease arthritis; edema; sepsis; septic shock; inflammation; infectious disease; thrombosis; traumatic hemorrhage; acute respiratory distress syndrome (ARDS); cardiovascular disease; atherosclerosis; radiotherapy toxicity; cytokine therapy toxicity; granulomatous disease; asthma; graft vs. host disease; cachexia; a coagulopathy; cancer; multiple organ dysfunction syndrome (MODS); or complications thereof.

7. The method of claim 1, further comprising administering at least one therapeutic agent to the subject, before, concurrently with or after the composition.

8. The method of claim 1, wherein the RNA comprises a modified nucleotide.

9. The method of claim 8, wherein the modified RNA comprises a 2' substituted sugar such as 2'-O-methyl-; 2'-O-(2-methoxyethyl); 2-O-alkyl; 2-O-allyl; 2'-S-alkyl; 2'-S-allyl; 2'-fluoro-; 2'-amino; 2'-halo or 2-azido-ribose, a carbocyclic sugar analogue, an a-anomeric sugar; an epimeric sugar such as arabinose, xylose or lyxose, a pyranose sugar, a furanose sugar, sedoheptulose; 2'-fluoro-β-D-arabinonucleotide (FANA) modification; or a Locked nucleic acid (LNA).

10. The method of claim 9, wherein the modified RNA comprises a 2'OMe purine and a 2'-fluoro pyrimidine.

11. The method of claim 1, wherein the therapeutic molecule is an RNAi molecule.

12. The method of claim 1, wherein the aptamer has 100% identity to KU7 (SEQ ID NO: 7741).

13. The method of claim 6, wherein the subject has MODS.

14. A method for binding extracellular histone 3 (H3) or histone 4 (H4) comprising contacting the extracellular H3 or H4 with a composition comprising an aptamer having at least 95% identity to KU7 (SEQ ID NO: 7741), wherein the aptamer specifically targets extracellular H3 or H4, wherein the nucleotides are RNA.

15. The method of claim 14, wherein the RNA comprises a modified nucleotide.

16. The method of claim 15, wherein the modified RNA comprises a 2' substituted sugar such as 2'-O-methyl-; 2'-O-(2-methoxyethyl); 2-O-alkyl; 2-O-allyl; 2'-S-alkyl; 2'-S-allyl; 2'-fluoro-; 2'-amino; 2'-halo or 2-azido-ribose, a carbocyclic sugar analogue, an a-anomeric sugar; an epimeric sugar such as arabinose, xylose or lyxose, a pyranose sugar, a furanose sugar, sedoheptulose; 2'-fluoro-β-D-arabinonucleotide (FANA) modification; or a Locked nucleic acid (LNA).

17. The method of claim 16, wherein the modified RNA comprises a 2'OMe purine and a 2'-fluoro pyrimidine.

\* \* \* \* \*